(12) United States Patent
Foekens et al.

(10) Patent No.: US 9,017,944 B2
(45) Date of Patent: *Apr. 28, 2015

(54) METHODS FOR THE PROGNOSIS OF BREAST CANCER

(75) Inventors: John Foekens, Rotterdam (NL); Nadia Harbeck, Otterfing (DE); Thomas Koenig, Berlin (DE); Sabine Maier, Brussels (BE); John W. Martens, Rotterdam (NL); Fabian Model, Berlin (DE); Inko Nimmrich, Berlin (DE); Manfred Schmitt, Munich (DE); Ralf Lesche, Berlin (DE); Dimo Dietrich, Berlin (DE); Volkmar Mueller, Hamburg (DE); Antje Kluth Lukas, Wentorf (DE); Ina Schwope, Berlin (DE); Oliver Hartmann, Berlin (DE); Peter Adorjan, Berlin (DE); Almuth Marx, Nuremberg (DE); Heinz Hoefler, Munich (DE)

(73) Assignee: Epigenomics AG, Berlin (DE)

( * ) Notice: Subject to any disclaimer, the term of this patent is extended or adjusted under 35 U.S.C. 154(b) by 1576 days.

This patent is subject to a terminal disclaimer.

(21) Appl. No.: 10/582,705

(22) PCT Filed: Dec. 13, 2004

(86) PCT No.: PCT/EP2004/014170
§ 371 (c)(1),
(2), (4) Date: Sep. 12, 2007

(87) PCT Pub. No.: WO2005/059172
PCT Pub. Date: Jun. 30, 2005

(65) Prior Publication Data
US 2008/0254447 A1    Oct. 16, 2008

(30) Foreign Application Priority Data

Dec. 11, 2003 (EP) .................................. 03090432
Feb. 10, 2004 (EP) .................................. 04090041
Apr. 1, 2004 (EP) .................................. 04090127
Jun. 5, 2004 (EP) .................................. 04013328
Sep. 30, 2004 (EP) .................................. 04090380
Nov. 16, 2004 (EP) .................................. 04027213

(51) Int. Cl.
*C12Q 1/68* (2006.01)

(52) U.S. Cl.
CPC ........ *C12Q 1/6886* (2013.01); *C12Q 2600/106* (2013.01); *C12Q 2600/118* (2013.01); *C12Q 2600/154* (2013.01); *C12Q 2600/158* (2013.01); *C12Q 2600/16* (2013.01)

(58) Field of Classification Search
None
See application file for complete search history.

(56) References Cited

U.S. PATENT DOCUMENTS

| | | |
|---|---|---|
| 5,574,142 A | 11/1996 | Meyer, Jr. et al. |
| 5,585,481 A | 12/1996 | Arnold, Jr. et al. |
| 5,587,371 A | 12/1996 | Sessler et al. |
| 5,597,696 A | 1/1997 | Linn et al. |
| 5,744,305 A | 4/1998 | Fodor et al. |
| 5,786,146 A | 7/1998 | Herman et al. |
| 5,837,832 A | 11/1998 | Chee et al. |
| 5,958,773 A | 9/1999 | Monia et al. |
| 6,265,171 B1 | 7/2001 | Herman et al. |
| 6,331,393 B1 | 12/2001 | Laird et al. |
| 6,596,488 B2 | 7/2003 | Pfeifer et al. |
| 8,101,359 B2 * | 1/2012 | Foekens et al. .............. 435/6.11 |
| 2003/0013091 A1 | 1/2003 | Dimitrov |
| 2006/0121467 A1 | 6/2006 | Foekens et al. |
| 2008/0254447 A1 * | 10/2008 | Foekens et al. ................... 435/6 |
| 2009/0215709 A1 * | 8/2009 | Van Criekinge et al. ....... 514/34 |

FOREIGN PATENT DOCUMENTS

| | | |
|---|---|---|
| WO | WO 95/00669 | 1/1995 |
| WO | WO 95/15373 | 6/1995 |
| WO | WO 97/45560 | 12/1997 |
| WO | WO 97/46705 | 12/1997 |
| WO | WO 99/28498 | 6/1999 |
| WO | WO 02/38801 | 5/2002 |
| WO | WO 02/059347 | 8/2002 |
| WO | WO 2004/000463 | 12/2003 |

OTHER PUBLICATIONS

Ehrlich et al. (Oncogene 2002. 21: 5400-5413).*
Nimmrich ((Breast Cancer Research and Treatment. 2008. 111:429-437).*
Ushijima (Nature Reviews. 2005. 5: 223-231).*
Martens et al (Cancer Research. 2005. 65(10): 4101-4107).*
Dermer, G.B. Bio/Technology (1994) 12: 320.*
Erlich et al. Oncogene 2002. 21: 5400-5413; p. 5401.*
Smiraglia et al. Human Molecular Genetics. 2001. 10: 1413-1419.*
Belyavsky et al., "PCR-based cDNA library construction: general cDNA libraries at the level of a few cells," Nucleic Adds Research, 1989, pp. 2919-2932, vol. 17, No. 8.
Berns et al., "Predictive value of SRC-1 for taxomifen response of recurrent breast cancer," Breast Cancer Research and Treatment, 1998, pp. 87-92, vol. 48.
Bieche et al., "The CGA gene as new predictor of the response to endocrine therapy in ERα-positive menopausal breast cancer patients," Oncogene, 2001, pp. 6955-6959, vol. 20.

(Continued)

*Primary Examiner* — Carla Myers
(74) *Attorney, Agent, or Firm* — DLA Piper LLP (US)

(57) ABSTRACT

The present invention relates to modified and genomic sequences, to oligonucleotides and/or PNA-oligomers for detecting the cytosine methylation state of genomic DNA, as well as to a method for predicting the disease free survival and/or response of a subject with a cell proliferative disorder of the breast tissues, to endocrine treatment.

10 Claims, 110 Drawing Sheets

(56) References Cited

OTHER PUBLICATIONS

Bieche et al., "Identification of CGA as a Novel Estrogen Receptor-responsive Gene in Breast Cancer: An Outstanding Candidate Marker to Predict the Response to Endocrine Therapy," Cancer Research, Feb. 15, 2001, pp. 1652-1658, vol. 61.

Ciocca et al., "Molecular Markers for Predicting Response to Tamoxifen in Breast Cancer Patients," Endocrine, Aug. 2000, pp. 1-10, vol. 13, No. 1.

Curran et al., "Quality of Life of Early-stage Breast Cancer Patients Treated with Radical Mastectomy or Breast-conserving Procedures: Results of EORTC Trial 10801," European Journal of Cancer, Feb. 1998, pp. 307-314, vol. 34, No. 3.

Database EMBL, "1M0228A10F Mouse 10kb plasmid UUGC1M library Mus musculus genomic clone UUGC1M0228A10 F, DNA sequence," XP002324932, Oct. 6, 2000, retrieved from EBI accession No. EM_Pro:AZ438069, Database accession No. AZ438069, Abstract.

Du et al., "Discrepancy between consensus Recommendations and Actual Community Use of Adjuvant Chemotherapy in Women with Breast Cancer," Annuals of Internal Medicine, Jan. 2003, pp. 90-98, vol. 138, No. 2.

Eads et al., "CpG Island Hypermethylation in Human Colorectal Tumors Is Not Associted with DNA Methyltransferase Overexpression," Cancer Research, May 15, 1999, pp. 2302-2306, vol. 59.

Elledge et al., "bcl-2, p53, and Response to Tamoxifen in Estrogen Receptor-Positive Metastatic Breast Cancer: A Southwest Oncology Group Study," Journal of Clinical Oncology, May 1997, pp. 1916-1922, vol. 15, No. 5.

Farczadi et al., "Changes in apoptosis, mitosis, Her-2, p53 and Bcl2 expression in breast carcinomas after short-term tamoxifen treatment," Neoplasma, 2002, pp. 101-103, vol. 49, No. 2.

Feil et al., "Methylation analysis on individual chromosomes: improved protocol for bisulphite genomic sequencing," Nucleic Acids Research, 1994, pp. 695-696, vol. 22, No. 4.

Galfre et al., "Preparation of monotonel antibodies: strategies and procedures" *Methods in Enzymology*, Colowick and Kaplan (editors-in-chief), Langone and Vunakis (editors), 1981, pp. 3-46, vol. 73, Immonochemical Techniques, Part B.

Gonzalgo et al., "Identification and Characterization of Differentially Methylated Regions of Genomic DNA by Methylation-sensitve Arbitrarily Primed PCR," Cancer Research, Feb. 15, 1997, pp. 594-599, vol. 57.

Gonzalgo et al., Rapid quantitation of methylation differences at specific sites using methylation-sensitive single nucleotide primer extension (Ms-SNuPE), Nucleic Acids Research, 1997, pp. 2529-2531, vol. 25, No. 12.

Gough et al., "Identification of the primary gene defect at the cytochrome P450 CYP2D locus," Nature, Oct. 25, 1990, pp. 773-776, vol. 347, No. 6295.

Greenlee et al., "Cancer Statistics, 2000," CA—A Cancer Journal for Clinicians, Jan./Feb. 2000, pp. 7-33, vol. 50, No. 1.

Grigg et al., "Sequencing 5-Methylcytosine Residues in Genomic DNA," BioEssays, Jun. 1994, pp. 431-436, vol. 16, No. 6.

Gut et al, "DNA and Matrix Assisted Laser Desorption Ionization Mass Spectrometry," Molecular Biology: Current Innovations and Future Trends, 1995, pp. 147-157, Horizon Scientific Press, Wymondham, United Kingdom.

Gut et al., "A procedure for selection DNA alkylation and detection by mass spectrometry," Nucleic Acids Research, 1995, pp. 1367-1373, vol. 23, No. 8.

Harbeck et al., "Clinical Relevance of Invasion Factors Urokinase-Type Plasminogen Activator and Plasminogen Activator Inhibitor Type 1 for Individualized Therapy Decisions in Primary Breast Cancer Is Greatest When Used in Combination," Journal of Clinical Oncology, Feb. 15, 2002, pp. 1000-1007, vol. 20, No. 4.

Heid et al., "Real Time Quantitative PCR," Genome Research, 1996, pp. 986-994, vol. 6.

Herman et al., "Methylation-specific PCR: A novel PCR assay for methylation status of CpG islands," Sep. 1996, pp. 9821-9826, vol. 93.

Houston et al., "Overexpression of c-erbB2 is an independent marker of resistance to endocrine therapy in advanced breast cancer," British Journal of Cancer, 1999, pp. 1220-1226, vol. 79, No. 7/8.

Jordan et al., "Chemoprevention of Breast Cancer: A Model for Change," Journal of Clinical Oncology, Jan. 1, 2002, pp. 1-3, vol. 20, No. 1.

Jordan et al., "Tamoxifen, Raloxifene, and the Prevention of Breast Cancer," Endocrine Reviews, 1999, pp. 253-278, vol. 20, No. 3.

Kang et al., "Methylation in th ep53 Promoter Is a Supplementary Route to Breast Carcinogenesis: Correlation between CpG Methylation in the p53 Promoter and the Mutation of the p53 Gene in the Progression from Ductal Carcinoma In Situ to Invasive Ductal Carcinoma," Laboratory Investigation, 2001, pp. 573-579, vol. 81, No. 4.

Karas et al., "Laser Desorption Ionization of Proteins with Molecular Masses Exceeding 10 000 Daltons," Analytical Chemistry, Oct. 15, 1988, pp. 2299-2301, vol. 60, No. 20.

Kim et al., "Hypermethylation of RASSF1A Promoter Is Associated with the Age at Starting Smoking and a Poor Prognosis in Primary Non-Small Cell Lung Cancer," Cancer Research, Jul. 1, 2003, pp. 3743-3746, vol. 63.

Koehler et al., "Continuous cultures of fused cells secreting antibody of predefined specificity," Nature, Aug. 7, 1975, pp. 495-497, vol. 256, No. 5517.

Krug et al., "First Strand cDNA Synthesis Primed with Oligo(dT)," Methods in Enzymology, 1987, pp. 316-325, vol. 152.

Kuzmin et al., "Inactivation of RAS Association Domain Family 1A Gene in Cervical Carcinomas and the Role of Human Papillomavirus Infection," Cancer Research, Apr. 15, 2003, pp. 1888-1893, vol. 63.

Lancet, "Polychemotherapy for early breast cancer: an overview of the randomised trials [Early Breast Cancer Trialists' Cooperative Group]," Sep. 19, 1998, pp. 930-942, vol. 352, No. 9132.

Lancet, "Tamoxifen for early breast cancer: an overview of the randomised trials [Early Breast Cancer Trialists' Cooperative Group]," May 16, 1998, pp. 1451-1467, vol. 351, No. 9114.

Lapidus et al., "Methylation of Estrogen and Progesterone Receptor Gene 5' CpG Islands Correlates with Lack of Estrogen and Progesterone Receptor Gene Expression in Breast Tumors," Clinical Cancer Research, May 1996, pp. 805-810, vol. 2.

Lücke et al., "Inhibiting Mutations in the Transforming Growth Factor β Type 2 Receptor in Recurrent Human Breast Cancer," Cancer Research, Jan. 15, 2001, pp. 482-485, vol. 61.

Mansour et al., "Survial Advantage of Adjuvant Chemotherapy in High-Risk Node-Negative Breast Cancer: Ten-Year Analysis—An Intergroup Study," Journal of Clinical Oncology, Nov. 1998, pp. 3486-3492, vol. 16, No. 11.

Martens et al., "Epigenetic signature predicts failure of endocrine therapy in patients with recurrent breast cancer," Breast Cancer Research and Treatment, Jun. 3, 2003, p. S72, vol. 82, No. Supp. 1, abstract only.

Martin et al., "Genomic sequencing indicates a correlation between DNA hypomethylation in the 5' region on the pS2 gene and its expression in human breast cancer cell lines," Gene, 1995, pp. 261-264, vol. 157.

Martin et al., "Involvement of DNA Methylation in the Control of the Expression of an Estrogen-Induced Breast-Cancer-Associated Protein (pS2) in Human Breast Cancers," Journal of Cellular Biochemistry, 1997, pp. 95-106, vol. 65.

Meyerson et al., "Identification of G1 Kinase Activity for cdk6, a Novel Cyclin D Partner," Molecular and Cellular Biology, Mar. 1994, pp. 2077-2086, vol. 14, No. 3.

Ojala et al., "mRNA differential display of gene expression in colonic carcinoma," Electrophoresis, Jun. 2002, pp. 1667-1676, vol. 23, No. 11.

Olek et al., "A modified and improved method for bisulphite based cytosine methylation analysis," Nucleic Acids Research, 1996, pp. 5064-5066, vol. 24, No. 24.

Olek et al., "The pre-implantation ontogeny of the H19 methylation imprint," Nature Genetics, Nov. 1997, pp. 275-276, vol. 17.

(56) References Cited

OTHER PUBLICATIONS

Osborne, "Tamoxifen in the Treatment of Breast Cancer," New England Journal of Medicine, Nov. 26, 1998, pp. 1609-1618, vol. 339, No. 22.

Ottaviano et al., "Methylation of the Estrogen Receptor Gene CpG Island Marks Loss of Estrogen Receptor Expression in Human Breast Cancer Cells," Cancer Research, May 15, 1994, pp. 2552-2555, vol. 54.

Pei et al., "PRC17, a Novel Oncogene Encoding a Rab GTPase-activating Protein, Is Amplified in Prostate Cancer," Cancer Research, Oct. 1, 2002, pp. 5420-5424, vol. 62.

Piccart et al., "The EORTC-Breast Cancer Cooperative Group Clinical Research Programme in Early Breast Cancer," Recent Results in Cancer Research, 1998, pp. 447-452, vol. 152.

Raman et al., "Compromised H0XA5 function can limit p53 expression in human breast tumors," Nature, Jun. 22, 2000, pp. 974-978, vol. 405.

Rein et al., "Survey and Summary Identifying 5-methylcytosine and related modifications in DNA genomes," Nucleic Acids Research, 1998, pp. 2255-2264, vol. 26, No. 10.

Ribieras et al., "The pS2/TFF1 trefoil factor, from basic research to clinical applications," Biochimica et Biophysica Acta, Jul. 19, 1998, pp. F61-F77, vol. 1378.

Rodrigues et al., "Cytochrome P450 Pharmacogenetics in Drug Development: In Vitro Studies and Clinical Consequences," Current Drug Metabolism, Jun. 2002, pp. 289-309, vol. 3, No. 3.

Sakai et al., "Prognostic Significance of β-Microseminoprotein mRNA Expression in Prostate Cancer," The Prostate, Mar. 1, 1999, pp. 278-284, vol. 38, No. 4.

Sanger et al., "DNA sequencing with chain-terminating inhibitors," PNAS, Dec. 1977, pp. 5463-5467, vol. 74, No. 12.

Schausi et al., "Regulation of the Intronic Promoter of Rat Estrogen Receptor a Gene, Responsible for Truncated Estrogen Receptor Product-1 Expression," Endocrinology, Jul. 2003, pp. 2845-2855, vol. 144, No. 7.

Schwartz et al., "pS2 Expression and Response to Hormonal Therapy in Patients with Advanced Breast Cancer," Cancer Research, Jan. 15, 1991, pp. 624-628, vol. 51.

Stites et al., "Clinical laboratory methods for detection of antigens and antibodies," *Basic and Clinical Immunology*, 7th ed., 1991, pp. 217-262, Appleton & Lange, Norwalk, Conn.

Suzuki et al., "Alcohol and Postmenopausal Breast Cancer Risk Defined by Estrogen and Progesterone Receptor Status: A Prospective Cohort Study," Journal of the National Cancer Institute, Nov. 2, 2005, pp. 1601-1608, vol. 97, No. 21.

Toyota et al., "Methylation profiling in acute myeloid leukemia," Blood, May 1, 2001, pp. 2823-2829, vol. 97, No. 9.

Umbricht et al., "Hypermethylation of 14-3-3 δ (stratifin) is an early event in breast cancer," Oncogene, 2001, pp. 3348-3353, vol. 20.

Van Der Krol et al., "Modulation of Eukaryotic Gene Expression by Complementary RNA or DNA Sequences," BioTechniques, Nov.-Dec. 1988, pp. 958-976, vol. 6, No. 10.

Virmani et al., "Hierarchical Clustering of Lung Cancer Cell Lines Using DNA Methylation Markers," Cancer Epidemiology, Biomarkers & Prevention, Mar. 2002, pp. 291-297, vol. 11.

Watanabe et al., "Isolation of Estrogen-Responsive Genes with a CpG Island Library," Molecular and Cellular Biology, Jan. 1998, pp. 442-449, vol. 18, No. 1.

Watson et al., "Isolation of Differentially Expressed Sequence Tags from Human Breast Cancer," Cancer Research, Sep. 1, 1994, pp. 4598-4602, vol. 54.

Xiong et al., "COBRA: a sensitive and quantitative DNA methylation assay," Nucleic Acids Research, 1997, pp. 2532-2534, vol. 25, No. 12.

Yu et al., "Specific Inhibition of PCR by Non-Extendable Oligonucleotides Using a 5' to 3' Exonuclease-Deficient DNA Polymerase," BioTechniques, Oct. 1997, pp. 714-720, vol. 23.

Yuan et al., "Hypermethylation Leads to Silencing of the SYK Gene in Human Breast Cancer," Cancer Research, Jul. 15, 2001, pp. 5558-5561, vol. 61.

Zeschnigk et al., "Imprinted segments in the human genome: different DNA methylation pattersn in the Prader-Willi/Angelman syndrome region as determined by the genomic sequencing method," Human Molecular Genetics, 1997, pp. 387-395, vol. 6, No. 3.

Zeschnigk et al., "A single-tube PCR test for the diagnosis of Angelman and Prader-Willi syndrome based on allelic methylation differences at the Snrpn locus," European Journal of Human Genetics, Mar.-Apr. 1997, pp. 94-98, vol. 5, No. 2.

Zon, "Oligonucleotide Analogues as Potential Chemotherapeutic Agents," Pharmaceutical Research, Sep. 1988, pp. 539-549, vol. 5, No. 9.

\* cited by examiner

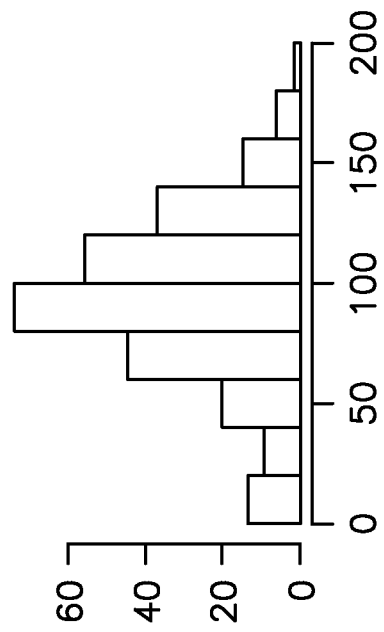
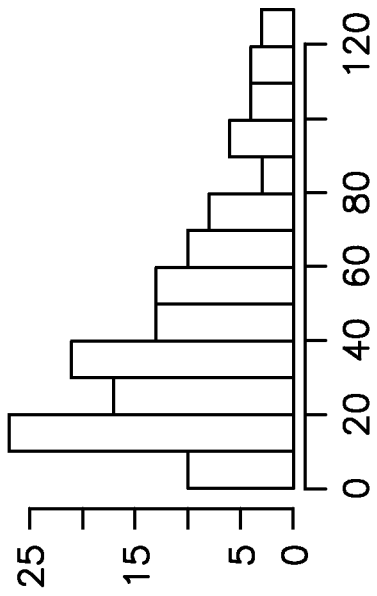
FIG. 99

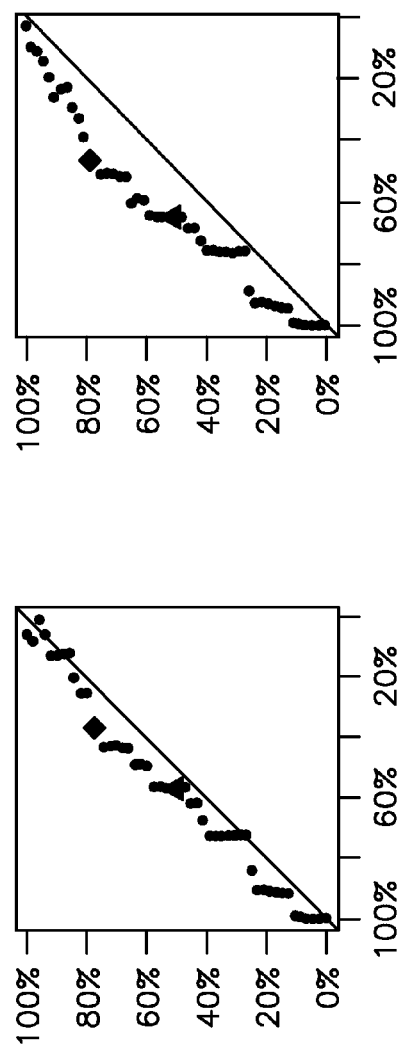
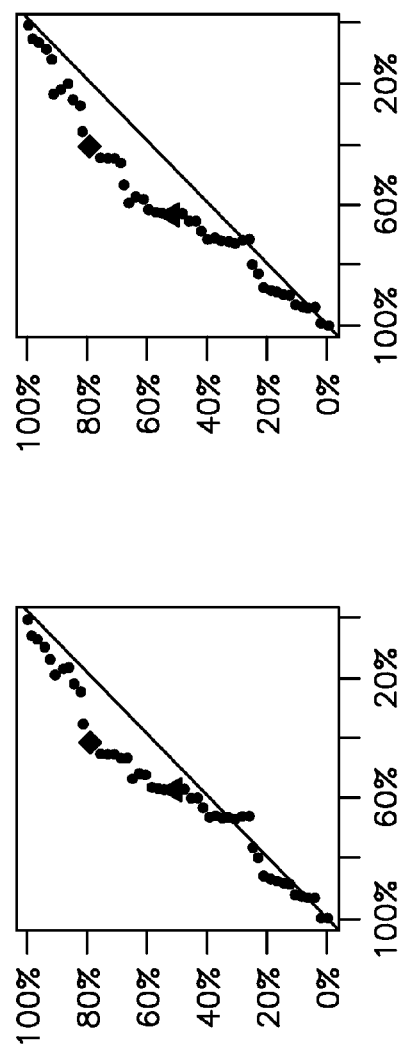
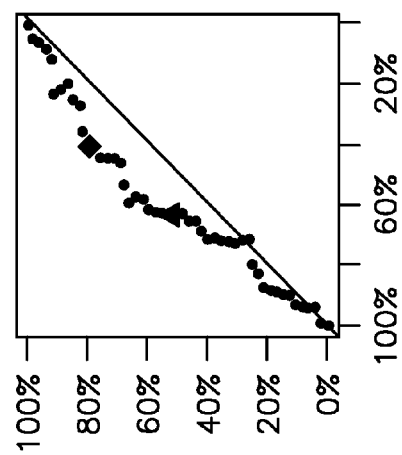

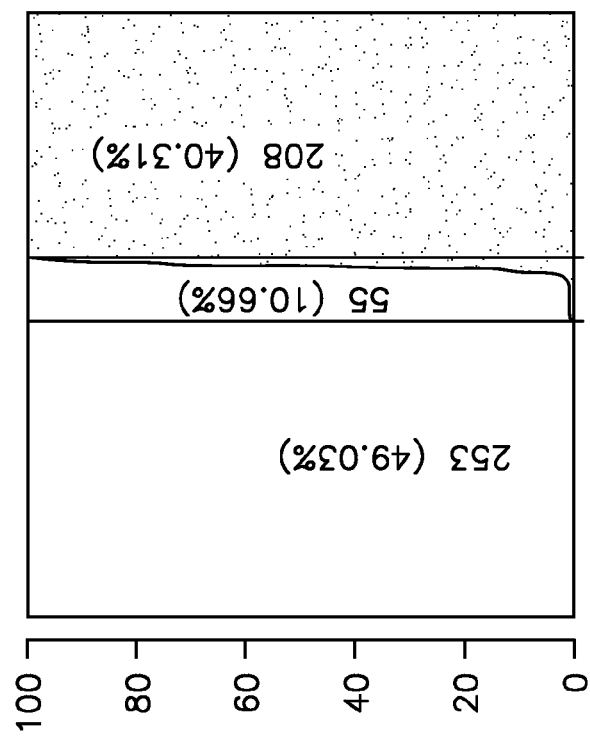
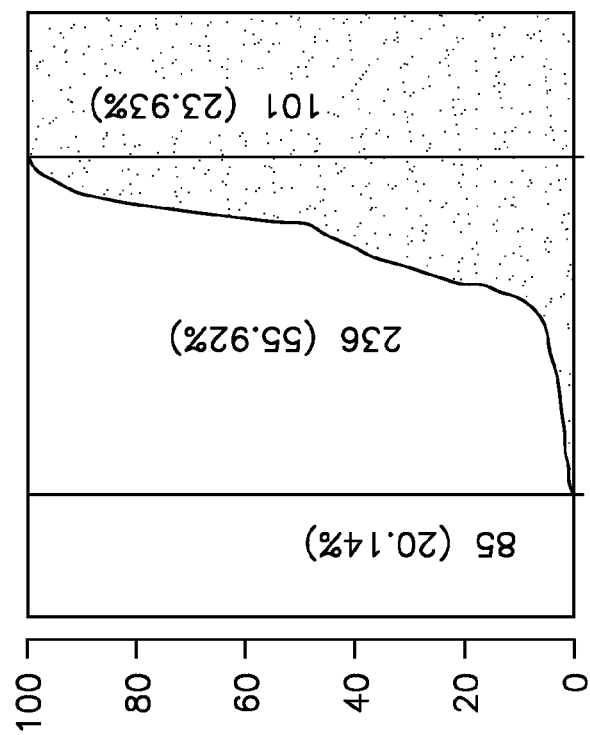
FIG. 106

METNCRKLVSACVQLGVQPAAVECLFSKDSEIKKVEFTDSPESRKEAASSKFFPRQ
HPGANEKDKSQQGKNEDVGAEDPSKKKRQRRQRTHFTSQQLQELEATFQRNRYP
DMSTREEIAVWTNLTEARVRVWFKNRRAKWRKRERNQQAELCKNGFGPQFNGL
MQPYDDMYPGYSYNNWAAKGLTSASLSTKSFPFFNSMNVNPLSSQSMFSPPNSISS
MSMSSSMVPSAVTGVPGSSLNSLNNLNNLSSPSLNSAVPTPACPYAPPTPPYVYRDT
CNSSLASLRLKAKQHSSFGYASVQNPASNLSACQYAVDRPV

FIG. 107

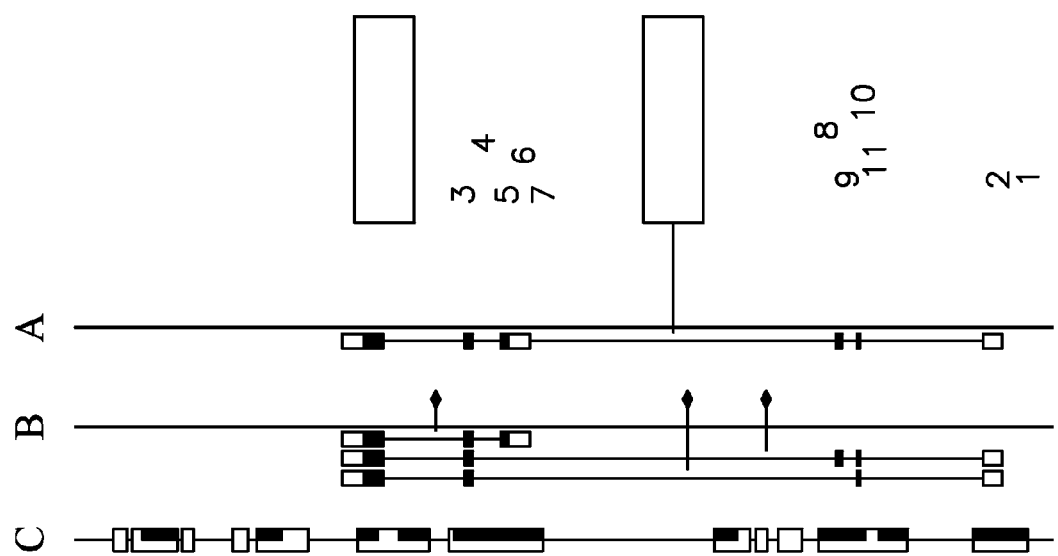

METHODS FOR THE PROGNOSIS OF BREAST CANCER

CROSS-REFERENCE TO RELATED APPLICATIONS

This application is a United States nationalization, under 35 U.S.C. §371, of PCT/EP04/014170, filed 13 Dec. 2004, and additionally claims the benefit of priority to European applications: EP 03090432.0, filed 11 Dec. 2003; EP 04090041.7, filed 10 Feb. 2004; EP 0490127.4, filed 1 Apr. 2004; EP 04013328.2, filed 5 Jun. 2004; EP 04090380.9, filed 30 Sep. 2004, and EP 04027213.0, filed 16 Nov. 2004, all of which are incorporated herein by reference in their entirety.

SEQUENCE LISTING

An electronic Sequence Listing has been provided as part of this application on compact disc (1 of 1) as a 2.25 MB text file, entitled "47675-198 Sequence Listing," and which is incorporated by reference herein in its entirety

FIELD OF THE INVENTION

In American women, breast cancer is the most frequently diagnosed cancer and the second leading cause of cancer death. In women aged 40-55, breast cancer is the leading cause of death (Greenlee et al., 2000). In 2002, there were 204,000 new cases of breast cancer in the US (data from the American Society of Clinical Oncology) and a comparable number in Europe.

Breast cancer is defined as the uncontrolled proliferation of cells within breasts tissues. Breasts are comprised of 15 to 20 lobes joined together by ducts. Cancer arises most commonly in the duct, but is also found in the lobes with the rarest type of cancer termed inflammatory breast cancer. It will be appreciated by those skilled in the art that there exists a continuing need to improve methods of early detection, classification and treatment of breast cancers. In contrast to the detection of some other common cancers such as cervical and dermal there are inherent difficulties in classifying and detecting breast cancers.

Due to current screening programs and the accessibility of this cancer to self-examination, breast cancer is diagnosed comparatively early: in about 93% of all newly diagnosed cases, the cancer has not yet metastasized, and in 65% of cases, even the lymph nodes are not yet affected.

The first step of any treatment is the assessment of the patient's condition comparative to defined classifications of the disease. However the value of such a system is inherently dependent upon the quality of the classification. Breast cancers are staged according to their size, location and occurrence of metastasis. Methods of treatment include the use of surgery, radiation therapy, chemotherapy and endocrine therapy, which are also used as adjuvant therapies to surgery.

Although the vast majority of early cancers are operable, i.e. the tumor can be completely removed by surgery, about one third of the patients with lymph-node negative diseases and about 50-60% of patients with node-positive disease will develop metastases during follow-up.

Based on this observation, systemic adjuvant treatment has been introduced for both node-positive and node-negative breast cancers. Systemic adjuvant therapy is administered after surgical removal of the tumor, and has been shown to reduce the risk of recurrence significantly (Early Breast Cancer Trialists' Collaborative Group, 1998). Several types of adjuvant treatment are available: endocrine treatment (for hormone receptor positive tumors), different chemotherapy regimens, and novel agents like Herceptin.

The growth of the majority of breast cancers (appr. 70-80%) is dependent on the presence of estrogen. Therefore, one important target for adjuvant therapy is the removal of estrogen (e.g. by ovarian ablation) or the blocking of its actions on the tumor cells (e.g. Tamoxifen). Endocrine treatment is thought to be efficient only in tumors that express hormone receptors (the estrogen receptor, ER, and/or the progesterone receptor, PR). Currently, the vast majority of women with hormone receptor positive breast cancer receive some form of endocrine treatment, independent of their nodal status. The most frequently used drug is Tamoxifen. However, even in hormone receptor positive patients, not all patients benefit from endocrine treatment. Adjuvant endocrine therapy reduces mortality rates by 22% while response rates to endocrine treatment in the advanced setting are 50 to 60% (Jordan et al., 2002, Jordan et al., 1999, Osborne et al., 1998, European Breast Cancer Cooperative Group, 1998).

Since Tamoxifen has relatively few side effects, treatment may be justified even for patients with low likelihood of benefit. However, these patients may require additional, more aggressive adjuvant treatment. This is supported by the fact that, even in earliest and least aggressive tumors, such as node-negative, hormone receptor positive tumours, about 21% of patients relapse within 10 years after initial diagnosis if they receive Tamoxifen monotherapy as adjuvant treatment (Early Breast Cancer Trialists Collaborative Group. Lancet, 1998).

Several cytotoxic regimens have shown to be effective in reducing the risk of relapse in breast cancer (Mansour et al., 1998). According to current treatment guidelines, most node-positive patients receive adjuvant chemotherapy both in the US and Europe, since the risk of relapse is considerable. Nevertheless, not all patients do relapse, and there is a proportion of patients who would never have relapsed even without chemotherapy, but who nevertheless receive chemotherapy due to the currently used criteria. In hormone receptor positive patients, chemotherapy is usually given before endocrine treatment, whereas hormone receptor negative patients receive only chemotherapy.

The situation for node-negative patients is particularly complex. In the US, cytotoxic chemotherapy is recommended for node-negative patients, if the tumor is larger than 1 cm. In Europe, chemotherapy is considered for the node-negative cases if one or more risk factors such as tumor size larger than 2 cm, negative hormone receptor status, or tumor grading of three or age <35 is present. In general, there is a tendency to select premenopausal women for additional chemotherapy whereas for postmenopausal women, chemotherapy is often omitted. Compared to endocrine treatment, in particular Tamoxifen, chemotherapy is highly toxic, with short-term side effects such as nausea, vomiting, bone marrow depression, and long-term effects such as cardiotoxicity and an increased risk for secondary cancers.

It is currently not clear which breast cancer patients should be selected for more aggressive therapy, although clinicians agree that there is a need for a subset of patients. The difficulty of selecting the right patients for chemotherapy, and the lack of suitable criteria is also reflected by a recent study which showed that chemotherapy is used much less frequently than recommended, based on data from the New Mexico Tumor registry (Du et al., 2003). This study provides substantial evidence that there is a need for better selection of patients for chemotherapy or other, more aggressive forms of breast cancer therapy.

The levels of observation that have been studied by the methodological developments of recent years in molecular biology, are the genes themselves, the translation of these genes into RNA, and the resulting proteins. The question of which gene is switched on at which point in the course of the development of an individual, and how the activation and inhibition of specific genes in specific cells and tissues are controlled is correlatable to the degree and character of the methylation of the genes or of the genome. In this respect, pathogenic conditions may manifest themselves in a changed methylation pattern of individual genes or of the genome.

DNA methylation plays a role, for example, in the regulation of the transcription, in genetic imprinting, and in tumorigenesis. Therefore, the identification of 5-methylcytosine as a component of genetic information is of considerable interest. However, 5-methylcytosine positions cannot be identified by sequencing since 5-methylcytosine has the same base pairing behaviour as cytosine. Moreover, the epigenetic information carried by 5-methylcytosine is completely lost during PCR amplification.

The currently most frequently used method for analysing DNA for 5-methylcytosine is based upon the specific reaction of bisulphite with cytosine which, upon subsequent alkaline hydrolysis, is converted to uracil which corresponds to thymine in its base pairing behaviour. However, 5-methylcytosine remains unmodified under these conditions. Consequently, the original DNA is converted in such a manner that methylcytosine, which originally could not be distinguished from cytosine by its hybridisation behaviour, can now be detected as the only remaining cytosine using "normal" molecular biological techniques, for example, by amplification and hybridisation or sequencing. All of these techniques are based on base pairing which can now be fully exploited. In terms of sensitivity, the prior art is defined by a method which encloses the DNA to be analysed in an agarose matrix, thus preventing the diffusion and renaturation of the DNA (bisulphite only reacts with single-stranded DNA), and which replaces all precipitation and purification steps with fast dialysis (Olek A, Oswald J, Walter J. A modified and improved method for bisulphite based cytosine methylation analysis. Nucleic Acids Res. 1996 Dec. 15; 24(24): 5064-6). Using this method, it is possible to analyse individual cells, which illustrates the potential of the method. However, currently only individual regions of a length of up to approximately 3000 base pairs are analysed, a global analysis of cells for thousands of possible methylation events is not possible. However, this method cannot reliably analyse very small fragments from small sample quantities either. These are lost through the matrix in spite of the diffusion protection.

An overview of the further known methods of detecting 5-methylcytosine may be gathered from the following review article: Rein, T., DePamphilis, M. L., Zorbas, H., Nucleic Acids Res. 1998, 26, 2255.

To date, barring few exceptions (e.g., Zeschnigk M, Lich C, Buiting K, Doerfler W, and Horsthemke B. A single-tube PCR test for the diagnosis of Angelman and Prader-Willi syndrome based on allelic methylation differences at the SNRPN locus. Eur J Hum Genet. 1997 March-April; 5(2):94-8) the bisulphite technique is only used in research. Always, however, short, specific fragments of a known gene are amplified subsequent to a bisulfite treatment and either completely sequenced (Olek A, Walter J. The pre-implantation ontogeny of the H19 methylation imprint. Nat. Genet. 1997 November; 17(3):275-6) or individual cytosine positions are detected by a primer extension reaction (Gonzalgo M L, Jones P A. Rapid quantitation of methylation differences at specific sites using methylation-sensitive single nucleotide primer extension (Ms-SNuPE). Nucleic Acids Res. 1997 Jun. 15; 25(12):2529-31, WO 95/00669) or by enzymatic digestion (Xiong Z, Laird P W. COBRA: a sensitive and quantitative DNA methylation assay. Nucleic Acids Res. 1997 Jun. 15; 25(12):2532-4). In addition, detection by hybridisation has also been described (Olek et al., WO 99/28498).

Further publications dealing with the use of the bisulfite technique for methylation detection in individual genes are: Grigg G, Clark S. Sequencing 5-methylcytosine residues in genomic DNA. Bioessays. 1994 June; 16(6):431-6, 431; Zeschnigk M, Schmitz B, Dittrich B, Buiting K, Horsthemke B, Doerfler W. Imprinted segments in the human genome: different DNA methylation patterns in the Prader-Willi/Angelman syndrome region as determined by the genomic sequencing method. Hum Mol. Genet. 1997 March; 6(3): 387-95; Feil R, Charlton J, Bird A P, Walter J, Reik W. Methylation analysis on individual chromosomes: improved protocol for bisulphite genomic sequencing. Nucleic Acids Res. 1994 Feb. 25; 22(4):695-6; Martin V, Ribieras S, Song-Wang X, Rio M C, Dante R. Genomic sequencing indicates a correlation between DNA hypomethylation in the 5' region of the pS2 gene and its expression in human breast cancer cell lines. Gene. 1995 May 19; 157(1-2):261-4; WO 97/46705, WO 95/15373, and WO 97/45560.

An overview of the Prior Art in oligomer array manufacturing can be gathered from a special edition of Nature Genetics (Nature Genetics Supplement, Volume 21, January 1999), published in January 1999, and from the literature cited therein.

Fluorescently labelled probes are often used for the scanning of immobilised DNA arrays. The simple attachment of Cy3 and Cy5 dyes to the 5'-OH of the specific probe is particularly suitable for fluorescence labels. The detection of the fluorescence of the hybridised probes may be carried out, for example via a confocal microscope. Cy3 and Cy5 dyes, besides many others, are commercially available.

Matrix Assisted Laser Desorption Ionisation Mass Spectrometry (MALDI-TOF) is a very efficient development for the analysis of biomolecules (Karas M, Hillenkamp F. Laser desorption ionisation of proteins with molecular masses exceeding 10,000 Daltons. Anal Chem. 1988 Oct. 15; 60(20): 2299-301). An analyte is embedded in a light-absorbing matrix. The matrix is evaporated by a short laser pulse thus transporting the analyte molecule into the vapour phase in an unfragmented manner. The analyte is ionised by collisions with matrix molecules. An applied voltage accelerates the ions into a field-free flight tube. Due to their different masses, the ions are accelerated at different rates. Smaller ions reach the detector sooner than bigger ones.

MALDI-TOF spectrometry is excellently suited to the analysis of peptides and proteins. The analysis of nucleic acids is somewhat more difficult (Gut I G, Beck S. DNA and Matrix Assisted Laser Desorption Ionization Mass Spectrometry. Current Innovations and Future Trends. 1995, 1; 147-57). The sensitivity to nucleic acids is approximately 100 times worse than to peptides and decreases disproportionally with increasing fragment size. For nucleic acids having a multiply negatively charged backbone, the ionisation process via the matrix is considerably less efficient. In MALDI-TOF spectrometry, the selection of the matrix plays an eminently important role. For the desorption of peptides, several very efficient matrixes have been found which produce a very fine crystallisation. There are now several responsive matrixes for DNA, however, the difference in sensitivity has not been reduced. The difference in sensitivity can be reduced by chemically modifying the DNA in such a manner that it becomes more similar to a peptide. Phosphorothioate nucleic acids in which the usual phosphates of the backbone are substituted with thiophosphates can be converted into a charge-neutral DNA using simple alkylation chemistry (Gut I G, Beck S. A procedure for selective DNA alkylation and detection by mass spectrometry. Nucleic Acids Res. 1995 Apr. 25; 23(8): 1367-73). The coupling of a charge tag to this modified DNA results in an increase in sensitivity to the same level as that found for peptides. A further advantage of charge tagging is the increased stability of the analysis against impurities which make the detection of unmodified substrates considerably more difficult.

Genomic DNA is obtained from DNA of cell, tissue or other test samples using standard methods. This standard methodology is found in references such as Sambrook, Fritsch and Maniatis, Molecular Cloning: A Laboratory Manual, CSH Press, 2nd edition, 1989: Isolation of genomic DNA from mammalian cells, Protocol I, p. 9.16-9.19. Also the manuals of several DNA extraction kits such as the QIAamp DNA mini kit give a good guidance on how to isolate genomic DNA.

Currently several predictive markers are under evaluation. As up to now most patients have received Tamoxifen as endocrine treatment most of the markers have been shown to be associated with response or resistance to Tamoxifen. However, it is generally assumed that there is a large overlap between responders to one or the other endocrine treatment. In fact, ER and PR expression are used to select patients for any endocrine treatment. Among the markers which have been associated with TAM response is bcl-2. High bcl-2 levels showed promising correlation to TAM therapy response in patients with metastatic disease and prolonged survival and added valuable information to an ER negative patient subgroup (J Clin Oncology, 1997, 15 5:1916-1922; Endocrine, 2000, 13(1):1-10). There is conflicting evidence regarding the independent predictive value of c-erbB2 (Her2/neu) overexpression in patients with advanced breast cancer that require further evaluation and verification (British J of Cancer, 1999, 79 (7/8):1220-1226; J Natl Cancer Inst, 1998, 90 (21): 1601-1608).

Other predictive markers include SRC-1 (steroid receptor coactivator-1), CGA gene over expression, cell kinetics and S phase fraction assays (Breast Cancer Res and Treat, 1998, 48:87-92; Oncogene, 2001, 20:6955-6959). Recently, uPA (Urokinase-type plasminogen activator) and PAI-1 (Plasminogen activator inhibitor type 1) together showed to be useful to define a subgroup of patients who have worse prognosis and who would benefit from adjuvant systemic therapy (J Clinical Oncology, 2002, 20 no 4). However, all of these markers need further evaluations in prospective trials as none of them is yet a validated marker of response.

A number of cancer-associated genes have been shown to be inactivated by hypermethylation of CpG islands during breast tumorigenesis. Decreased expression of the calcium binding protein S100A2 (Accession number NM_005978) has been associated with the development of breast cancers. Hypermethylation of the promoter region of this gene has been observed in neoplastic cells thus providing evidence that S100A2 repression in tumour cells is mediated by site-specific methylation.

The gene SYK (Accession number NM_003177) encodes a protein tyrosine kinase, Syk (spleen tyrosine kinase), that is highly expressed in hematopoietic cells. Syk is expressed in normal breast ductal epithelial cells but not in a subset of invasive breast carcinoma. Also, the loss of Syk expression seems to be associated with malignant phenotypes such as increased motility and invasion. The loss of expression occurs at the transcriptional level, and, as indicated by Yuan Y, Mendez R, Sahin A and Dai J L (Hypermethylation leads to silencing of the SYK gene in human breast cancer. Cancer Res. 2001 Jul. 15; 61(14):5558-61.), as a result of DNA hypermethylation.

The TGF-β type 2 receptor (encoded by the TGFBR2 gene, NM_003242) plays a role in trans-membrane signalling pathways via a complex of serine/threonine kinases. Mutations in the gene have been detected in some primary tumours and in several types of tumour-derived cell lines, including breast (Lucke C D, Philpott A, Metcalfe J C, Thompson A M, Hughes-Davies L, Kemp P R, Hesketh R. 'Inhibiting mutations in the transforming growth factor beta type 2 receptor in recurrent human breast cancer.' Cancer Res. 2001 Jan. 15; 61(2):482-5.).

The genes COX7A2L and GRIN2D were both identified as novel estrogen responsive elements by Watanabe et. al. (Isolation of estrogen-responsive genes with a CpG island library. Molec. Cell. Biol. 18: 442-449, 1998.) using the CpG-GBS (genomic binding site) method. The gene COX7A2L (Accession number NM_004718) encodes a polypeptide 2-like cytochrome C oxidase subunit VIIA. Northern blot analysis detected an upregulation of COX7A2L after estrogen treatment of a breast cancer cell line. The gene GRIN2D (Accession number NM_000836) encodes the N-methyl-D-aspartate, ionotropic, subunit 2D glutamate receptor, a subunit of the NMDA receptor channels associated with neuronal signalling. Furthermore expression of the cDNA has been observed in an osteosarcoma cell line. The gene VTN (also known as Vitronectin Accession number NM_000638) encodes a 75-kD glycoprotein (also called serum spreading factor or complement S-protein) that promotes attachment and spreading of animal cells in vitro, inhibits cytolysis by the complement C5b-9 complex, and modulates antithrombin III-thrombin action in blood coagulation. Furthermore expression of this gene has been linked to progression and invasiveness of cancer cells.

The gene SFN (also known as Stratifin) encodes a polypeptide of the 14-3-3 family, 14-3-3 sigma. The 14-3-3 family of proteins mediates signal transduction by binding to phosphoserine-containing proteins. Expression of the SFN gene is lost in breast carcinomas, this is likely due to hypermethylation during the early stages of neoplastic transformation (see Umbricht C B, Evron E, Gabrielson E, Ferguson A, Marks J, Sukumar S. Hypermethylation of 14-3-3 sigma (stratifin) is an early event in breast cancer. Oncogene. 2001 Jun. 7; 20(26):3348-53).

The gene PSAT1 (Accession number NM_021154) is not to be confused with the gene popularly referred to as PxySA (Accession number NM_001648) which encodes prostate specific antigen and whose technically correct name is kallikrein 3. The gene PSAT1 encodes the protein phosphoserine aminotransferase which is the second step-catalysing enzyme in the serine biosynthesis pathway. Changes in gene expression levels have been monitored by mRNA expression analysis and upregulation of the gene has been identified in colonic carcinoma in a study of 6 samples (Electrophoresis 2002 June; 23(11):1667-76 mRNA differential display of gene expression in colonic carcinoma. Ojala P, Sundstrom J, Gronroos J M, Virtanen E, Talvinen K, Nevalainen T J).

The gene stathmin (NM_005563) codes for an oncoprotein 18, also known as stathmin, a conserved cytosolic phosphoprotein that regulates microtubule dynamics. The protein is highly expressed in a variety of human malignancies. In human breast cancers the stathmin gene has shown to be up-regulated in a subset of the tumours.

The gene PRKCD encodes a member of the family of protein kinase c enzymes, and is involved in B cell signaling and in the regulation of growth, apoptosis, and differentiation of a variety of cell types.

Some of these molecules interact in a cascade-like manner. PRKCD activity that targets STMN1 is modulated by SFN binding and SYK phosphorylation. Together this influences tubulin polymerization that is required for cell division.

The gene MSMB (Accession number NM_002443) has been mapped to 10q11.2. It encodes the beta-microseminoprotein (MSP) which is one of the major proteins secreted by the prostate. Furthermore, it may be useful as a diagnostic marker for prostate cancer. Using mRNA analysis low levels of beta-MSP mRNA expression and protein have been linked to progression under endocrine therapy and it has been postulated that it may be indicative of potentially aggressive prostate cancer (see Sakai H, Tsurusaki T, Kanda S, Koji T, Xuan J W, Saito Y 'Prognostic significance of beta-microseminoprotein mRNA expression in prostate cancer.' Prostate. 1999 Mar. 1; 38(4):278-84.).

The gene TP53 (Accession number NM_000546) encodes the protein p53, one of the most well characterised tumour suppressor proteins. The p53 protein acts as a transcription factor and serves as a key regulator of the cell cycle. Inactivation of this gene through mutation disrupts the cell cycle, which, in turn, assists in tumour formation. Methylation changes associated with this gene have been reported to be significant in breast cancer. Saraswati et. al. (Nature 405, 974-978 (22 Jun. 2000) 'Compromised HOXA5 function can limit p53 expression in human breast tumours' reported that low levels of p53 mRNA in breast tumours was correlated to methylation of the HOXA5 gene. The product of the HOX5A gene binds to the promoter region of the p53 and mediates expression of the gene. Methylation of the promoter region of the p53 gene itself has been reported (Kang J H, Kim S J, Noh D Y, Park I A, Choe K J, Yoo O J, Kang H S. 'Methylation in the p53 promoter is a supplementary route to breast carcinogenesis: correlation between CpG methylation in the p53 promoter and the mutation of the p53 gene in the progression from ductal carcinoma in situ to invasive ductal carcinoma.' Lab Invest. 2001 April; 81(4):573-9.). It was therein demonstrated that CpG methylation in the p53 promoter region is found in breast cancer and it was hypothesised that methylation in the p53 promoter region could be an alternative pathway to neoplastic progression in breast tumours. It has been observed that treatment with Tamoxifen decreases the level of expression of the p53 gene (Farczadi E, Kaszas I, Baki M, Szende B. 'Changes in apoptosis, mitosis, Her-2, p53 and Bcl2 expression in breast carcinomas after short-term tamoxifen treatment.' Neoplasma. 2002; 49(2):101-3.)

The gene CYP2D6 (Accession number: NM_000106) is a member of the human cytochrome P450 (CYP) superfamily. Many members of this family are involved in drug metabolism (see for example Curr Drug Metab. 2002 June; 3(3):289-309. Rodrigues A D, Rushmore T H.), of these Cytochrome P450 CYP2D6 is one of the most extensively characterised. It is highly polymorphic (more than 70 variations of the gene have been described), and allelic variation can result in both increased and decreased enzymatic activity. The CYP2D6 enzyme catalyses the metabolism of a large number of clinically important drugs including antidepressants, neuroleptics, some antiarrhythmics (Nature 1990 Oct. 25; 347(6295): 773-6 Identification of the primary gene defect at the cytochrome P450 CYP2D locus. Gough A C, Miles J S, Spurr N K, Moss J E, Gaedigk A, Eichelbaum M, Wolf C R.).

The gene PTGS2 (Accession number NM_000963) encodes an inducible isozyme of prostaglandin-endoperoxide synthase (prostaglandin-endoperoxide synthase 2). It is also known as COX2 (cyclooxygenase 2). Aberrant methylation of this gene has been identified in lung carcinomas (Cancer Epidemiol Biomarkers Prev 2002 March; 11(3):291-7 Hierarchical clustering of lung cancer cell lines using DNA methylation markers. Virmani A K, Tsou J A, Siegmund K D, Shen L Y, Long T I, Laird P W, Gazdar A F, Laird-Offringa I A.).

The gene CGA (Accession number NM_000735) encodes the alpha polypeptide of glycoprotein hormones. Further, it has been identified as an estrogen receptor alpha (ER alpha)-responsive gene and overexpression of the gene has been linked to ER positively in breast tumours. Bieche et. al examined mRNA levels of said gene in 125 ER alpha-positive post-menopausal breast cancer patients treated with primary surgery followed by adjuvant tamoxifen therapy. Initial results indicated significant links between CGA gene overexpression and Scarff-Bloom-Richardson histopathological grade I+II and progesterone and estrogen receptor positivity, which suggested that CGA is a marker of low tumour aggressiveness ('Identification of CGA as a Novel Estrogen Receptor-responsive Gene in Breast Cancer: An Outstanding Candidate Marker to predict the Response to Endocrine Therapy Cancer Research' 61, 1652-1658, Feb. 15, 2001. Ivan Bièche, Béatrice Parfait, Vivianne Le Doussal, Martine Olivi, Marie-Christine Rio, Rosette Lidereau and Michel Vidaud). Further mRNA expression analysis linked CGA expression levels to Tamoxifen response, it was postulated that when combined with analysis of the marker ERBB2 (a marker of poor response) the gene may be useful as a predictive marker of tamoxifen responsiveness in breast cancer (Oncogene 2001 Oct. 18; 20(47):6955-9 The CGA gene as new predictor of the response to endocrine therapy in ER alpha-positive post-menopausal breast cancer patients. Bieche I, Parfait B, Nogues C, Andrieu C, Vidaud D, Spyratos F, Lidereau R, Vidaud M.). The authors provided significant data associating the expression of the gene CGA with Tamoxifen treatment response. However, said analyses have all focused upon the analysis of relative levels of mRNA expression. This is not a methodology that is suitable for a medium or high throughput, nor is it a suitable basis for the development of a clinical assay.

The gene PITX2 (NM_000325) encodes the paired-like homeodomain transcription factor 2 which is known to be expressed during development of anterior structures such as the eye, teeth, and anterior pituitary. Although the expression of this gene is associated with cell differentiation and proliferation it has no heretofore recognised role in carcinogenesis or responsiveness to endocrine treatment. Toyota et al., (2001. Blood. 97:2823-9.) found hypermethylation of the PITX2 gene in a large proportion of acute myeloid leukemias. Furthermore, this hypermethylation is positively correlated to methylation of the ER gene.

RASSF1A (Ras association domain family 1A) gene is a candidate tumour suppressor gene at 3p21.3. The Ras GTPases are a superfamily of molecular switches that regulate cellular proliferation and apoptosis in response to extracellular signals. It is purported that RASSF1A is a tumour suppressor gene, and epigenetic alterations of this gene have been observed in a variety of cancers. Methylation of RASSF1A has been associated with poor prognosis in primary non-small cell lung cancer (Kim D H, Kim J S, Ji Y I, Shim Y M, Kim H, Han J, Park J., 'Hypermethylation of RASSF1A promoter is associated with the age at starting smoking and a poor prognosis in primary non-small cell lung cancer.' Cancer Res. 2003 Jul. 1; 63(13):3743-6.). It has also been associated with the development of pancreatic cancer (Kuzmin I, Liu L, Dammann R, Geil L, Stanbridge E J, Wilczynski S P, Lerman M I, Pfeifer G P. 'Inactivation of RAS association domain family 1A gene in cervical carcinomas and the role of human papillomavirus infection.' Cancer Res. 2003 Apr. 15; 63(8):1888-93.), as well as testicular tumours and prostate carcinoma amongst others. The application of the methylation of this gene as a cancer diagnostic marker has been described in U.S. Pat. No. 6,596,488, it does not however describe its application in the selection of appropriate treatments regimens for patients.

Also located within 3p21 is the Dystroglycan precursor gene (Dystrophin-associated glycoprotein 1) (NM_004393). Dystroglycan (DG, also known as DAG1) is an adhesion molecule comprising two subunits namely alpha-DG and beta-DG. The molecule is responsible for crucial interactions between extracellular matrix and cytoplasmatic compartment and it has been hypothesised that as such it may contribute to progression to metastatic disease. Decreased expression of this gene has been associated with correlated with higher tumour grade and stage in colon, prostate and breast tumours.

The onecut-2 transcription factor gene (NM_004852) is located at 18q21.31 is a homeodomain transcription factor regulator of liver gene expression in adults and during development.

The trefoil factor 1 (TFF1) gene (NM_003225) encodes a member of the trefoil family of proteins. The gene is also known as pS2. They are normally expressed at highest levels in the mucosa of the gastrointestinal tract, however they are often expressed ectopically in primary tumours of other tissues, including breast. The expression of TFF1 is regulated by estrogen in estrogen-responsive breast cancer cells in culture, its expression is associated with that of the estrogen receptor and TFF1 is a marker of hormone responsiveness in tumours (Schwartz et al., 1991. pS2 expression and response to hormonal therapy in patients with advanced breast cancer. Cancer Res. 51:624-8). TFF1 promoter methylation has been observed in nonexpressing gastric carcinoma-derived cell lines and tissues.

TMEFF2 (NM_016192) encodes a transmembrane protein containing an epidermal growth factor (EGF)-like motif and two follistatin domains. It has been shown to be overexpressed in prostate and brain tissues and it has been suggested that this is an androgen-regulated gene exhibiting antiproliferative effects in prostate cancer cells.

Methylation of the gene ESR1 (NM_000125), encoding the estrogen receptor has been linked to several cancer types including lung, oesophageal, brain and colorectal. The estrogen receptor (ESR) is a ligand-activated transcription factor composed of several domains important for hormone binding, DNA binding, and activation of transcription. Furthermore, it is the direct target of the anti-estrogenic compound Tamoxifen. Only tumours expressing estrogen receptor (ER+) can respond on Tamoxifen treatment.

The PCAF (NM_003884) gene encodes the p300/CBP-Associated Factor (PCAF). CBP and p300 are large nuclear proteins that bind to many sequence-specific factors involved in cell growth and/or differentiation. The p300/CBP associated factor displays in vivo binding activity with CBP and p300. The protein has histone acetyl transferase activity with core histones and nucleosome core particles, indicating that it plays a direct role in transcriptional regulation. p300/CBP associated factor also associates with NF-kappa-B p65. This protein has been shown to regulate expression of the gene p53 by acetylation of Lys320 in the C-terminal portion of p53.

The WBP11 (NM_016312) gene encodes a nuclear protein, which co-localises with mRNA splicing factors and intermediate filament-containing perinuclear networks. It contains two proline-rich regions that bind to the WW domain of Npw38, a nuclear protein, and thus this protein is also called Npw38-binding protein NpwBP.

The TBC1 domain family, member 3 gene (TBC1D3, NM_032258) was discovered originally as an oncogene, also known as PRC17. The gene product contains a GTPase-activating protein (GAP) catalytic core motif and interacts directly with Rab5, stimulating its GTP hydrolysis. TBC1D3 is amplified in 15% of prostate cancers and highly overexpressed in approximately one-half of metastatic prostate tumors (Pei et al., 2002; Cancer Res. 62:5420-4).

The CDK6 gene encodes a cyclin-dependent protein kinase regulating major cell cycle transitions in eukaryotic cells. The cdk6 kinase is associated with cyclins D1, D2, and D3 and can phosphorylate pRB, the product of the retinoblastoma tumor suppressor gene. The activation of cdk6 kinase occurs during mid-G1 (Meyerson and Harlow, 1994; Mol Cell Biol. 14:2077-86).

DESCRIPTION

In the following certain genetic regions are described for whom no genetic nomenclature is presently available. In each case the chromosomal location of the genetic sequence is denoted within parentheses ( ) and the genetic sequence is further described by its sequence according to Table 1.

The present invention provides methods and nucleic acids for the improved treatment planning of patients with cell proliferative disorders of the breast tissues. The aim of the invention is achieved by assessment of one or both of two factors of particular relevance to patient treatment planning. The first factor is the characterisation of the cell proliferative disorder of the breast tissues and/or a metastases thereof in terms of aggresivity, the second factor being the prediction of disease free survival and/or response of a subject with said disorder to a therapy comprising one or more treatments which target the estrogen receptor pathway or are involved in estrogen metabolism, production or secretion. Said treatments include, but are not limited to estrogen receptor modulators, estrogen receptor down-regulators, aromatase inhibitors, ovarian ablation, LHRH analogues and other centrally acting drugs influencing estrogen production.

The prediction of response to a therapeutic regimen comprising one or more treatments which target the estrogen receptor pathway or are involved in estrogen metabolism, production or secretion (a current treatment of choice as side effects are limited) further enables the physician to determine if additional treatments will be required in addition to or instead of this treatment. Treatments which may be used in addition to or instead of said treatment include, but are not limited to chemotherapy, radiotherapy, surgery, biological therapy, immunotherapy, antibodies and molecularly targeted drugs.

Characterisation of a breast cancer in terms of its predicted aggressiveness enables the physician to make an informed decision as to a therapeutic regimen with appropriate risk and benefit trade offs to the patient. Aggressiveness is taken to mean one or more of decreased patient survival or disease- or relapse-free survival, increased tumor-related complications and faster progression of tumor or metastases. According to the aggressiveness of the disease an appropriate treatment or treatments may be selected from the group consisting of chemotherapy, radiotherapy, surgery, biological therapy, immunotherapy, antibody treatments, treatments involving molecularly targeted drugs, estrogen receptor modulator treatments, estrogen receptor down-regulator treatments, aromatase inhibitors treatments, ovarian ablation, treatments providing LHRH analogues or other centrally acting drugs influencing estrogen production. Wherein a cancer is characterised as 'aggressive' it is particularly preferred that a treatment such as, but not limited to, chemotherapy is provided in addition to or instead of an endocrine targeting therapy.

Using the methods and nucleic acids described herein, statistically significant models of patient disease free survival and/or responsiveness to treatment and/or disease progression can be developed and utilised to assist patients and clinicians in determining suitable treatment options to be included in the therapeutic regimen. In one aspect the described method is to be used to assess the utility of therapeutic regimens comprising one or more treatments which target the estrogen receptor pathway or are involved in estrogen metabolism, production or secretion as a therapy for patients suffering from a cell proliferative disorder of the breast tissues. In particular this aspect of the method enables the physician to determine which treatments may be used in addition to or instead of said treatment. In a further aspect the described method enables the characterisation of the cell proliferative disorder in terms of aggressiveness, thereby enabling the physician to recommend suitable treatments. Thus, the present invention will be seen to reduce the problems associated with present breast cell proliferative disorder treatment response prediction methods.

Using the methods and nucleic acids as described herein, patient responsiveness can be evaluated before or during treatment for a cell proliferative disorder of the breast tissues, in order to provide critical information to the patient and clinician as to the likely progression of the disease. It will be appreciated, therefore, that the methods and nucleic acids exemplified herein can serve to improve a patient's quality of life and odds of treatment success by allowing both patient and clinician a more accurate assessment of the patient's treatment options.

The method according to the definition may be used for the improved treatment of all breast cell proliferative disorder patients, both pre and post menopausal and independent of their node or estrogen receptor status. However, it is particularly preferred that said patients are node-negative and estrogen receptor positive.

The aim of the invention is most preferably achieved by means of the analysis of the methylation patterns of one or a combination of genes taken from the group taken from the group EGR4, APC, CDKN2A, CSPG2, ERBB2, STMN1, STK11, CA9, PAX6, SFN, S100A2, TFF1, TGFBR2, TP53, TP73, PLAU, TMEFF2, ESR1, SYK, HSPB1, RASSF1, TES, GRIN2D, PSAT1, CGA, CYP2D6, COX7A2L, ESR2, PLAU, VTN, SULT1A1, PCAF, PRKCD, ONECUT2, BCL6, WBP11, (MX1)MX1, APP, ORC4L, NETO1, TBC1D3, GRB7, CDK6, SEQ ID NO: 47, SEQ ID NO: 48, ABCA8, SEQ ID NO: 50, SEQ ID NO: 51, MARK2, ELK1, Q8WUT3, CGB, BSG, BCKDK, SOX8, DAG1, SEMA4B, and ESR1 (exon8) (see Table 1) and/or their regulatory regions.

The invention is characterised in that the nucleic acid of one or a combination of genes taken from the group EGR4, APC, CDKN2A, CSPG2, ERBB2, STMN1, STK11, CA9, PAX6, SFN, S100A2, TFF1, TGFBR2, TP53, TP73, PLAU, TMEFF2, ESR1, SYK, HSPB1, RASSF1, TES, GRIN2D, PSAT1, CGA, CYP2D6, COX7A2L, ESR2, PLAU, VTN, SULT1A1, PCAF, PRKCD, ONECUT2, BCL6, WBP11, (MX1)MX1, APP, ORC4L, NETO1, TBC1D3, GRB7, CDK6, SEQ ID NO: 47, SEQ ID NO: 48, ABCA8, SEQ ID NO: 50, SEQ ID NO: 51, MARK2, ELK1, Q8WUT3, CGB, BSG, BCKDK, SOX8, DAG1, SEMA4B, and ESR1 (exon8) are contacted with a reagent or series of reagents capable of distinguishing between methylated and non methylated CpG dinucleotides within the genomic sequence of interest.

The present invention makes available a method for the improved treatment and monitoring of breast cell proliferative disorders, by enabling the accurate prediction of a patient's disease free survival and/or response to treatment with a therapy comprising one or more treatments which target the estrogen receptor pathway or are involved in estrogen metabolism, production, or secretion.

In a particularly preferred embodiment, the method according to the invention enables the differentiation between patients who have a high probability of response to said therapy and those who have a low probability of response to said therapy or a methylation characteristic predicted disease free survival time, in addition to the characterisation of tumors in terms of aggressiveness.

The method according to the invention may be used for the analysis of a wide variety of cell proliferative disorders of the breast tissues including, but not limited to, ductal carcinoma in situ, invasive ductal carcinoma, invasive lobular carcinoma, lobular carcinoma in situ, comedocarcinoma, inflammatory carcinoma, mucinous carcinoma, scirrhous carcinoma, colloid carcinoma, tubular carcinoma, medullary carcinoma, metaplastic carcinoma, and papillary carcinoma and papillary carcinoma in situ, undifferentiated or anaplastic carcinoma and Paget's disease of the breast.

The method according to the invention is particularly suited to the prediction of response to the aforementioned therapy in two treatment settings. In one embodiment, the method is applied to patients who receive endocrine pathway targeting treatment as secondary treatment to an initial non chemotherapeutical therapy, e.g. surgery (hereinafter referred to as the adjuvant setting) as illustrated in FIG. 1. Such a treatment is often prescribed to patients suffering from Stage 1 to 3 breast carcinomas. In this embodiment patients disease free survival times are predicted according to their by detecting patients with worse disease free survival times the physician may choose to recommend the patient for further treatment, instead of or in addition to the endocrine targeting therapy(s), in particular but not limited to, chemotherapy. In a further preferred embodiment said method is applied to patients suffering from a relapse of breast cancer following treatment by a primary means (preferably surgery) followed by a disease free period, and wherein the endocrine pathway targeting treatment has been prescribed in response to a detection of a relapse of the carcinoma. Such a treatment is often prescribed to patients suffering from later stage carcinomas, particularly wherein metastasis has occurred. Therefore this clinical setting shall also hereinafter be referred to as the 'metastatic setting'. In this embodiment responders are those who enter partial or complete remission i.e. subjects whose cancer recedes to undetectable levels as opposed to those whose diseases further metastasise or remain above detectable levels. By detecting patients whose cancers are likely to metastasis the physician may choose to recommend the patient for further treatment, instead of or in addition to the endocrine targeting therapy(s), in particular but not limited to, chemotherapy.

This methodology presents further improvements over the state of the art in that the method may be applied to any subject, independent of the estrogen and/or progesterone receptor status. Therefore in a preferred embodiment, the subject is not required to have been tested for estrogen or progesterone receptor status.

The object of the invention is achieved by means of the analysis of the methylation patterns of one or more of the genes EGR4, APC, CDKN2A, CSPG2, ERBB2, STMN1, STK11, CA9, PAX6, SFN, S100A2, TFF1, TGFBR2, TP53, TP73, PLAU, TMEFF2, ESR1, SYK, HSPB1, RASSF1, TES, GRIN2D, PSAT1, CGA, CYP2D6, COX7A2L, ESR2, PLAU, VTN, SULT1A1, PCAF, PRKCD, ONECUT2, BCL6, WBP11, (MX1)MX1, APP, ORC4L, NETO1, TBC1D3, GRB7, CDK6, SEQ ID NO: 47, SEQ ID NO: 48, ABCA8, SEQ ID NO: 50, SEQ ID NO: 51, MARK2, ELK1, Q8WUT3, CGB, BSG, BCKDK, SOX8, DAG1, SEMA4B, ESR1 (exon8) and/or their regulatory regions. In a particularly preferred embodiment the sequences of said genes comprise SEQ ID NOs: 1-61 and sequences complementary thereto.

The object of the invention may also be achieved by analysing the methylation patterns of one or more genes taken from the following subsets of said aforementioned group of genes. In one embodiment the object of the invention is the prediction of disease free survival and/or probability of response to a treatment which targets the estrogen receptor pathway or are involved in estrogen metabolism, production or secretion. This is achieved by analysis of the methylation patterns of one or more genes taken from the group consisting ERBB2, STMN1, TFF1, TMEFF2, ESR1, HSPB1, PITX2, COX7A2L, PLAU, VTN, PCAF, ONECUT2, BCL6, WBP11, TBC1D3, GRB7, CDK6, SEQ ID NO: 47, ABCA8 and SEQ ID NO: 51 and wherein it is further preferred that the sequence of said genes comprise SEQ ID NOs: 5, 6, 12, 17, 18, 20, 23, 28, 16, 31, 33, 35, 36, 37, 43, 44, 46, 47, 49 and 51, respectively, according to Table 1. It is preferred that said gene is PITX2.

It is preferred that the object of the invention is achieved by analysing the methylation patterns of a plurality of genes, hereinafter also referred to as a gene panel. It is further preferred that said plurality is between two and four genes. PITX2 In one embodiment said gene panel consists of PITX2, TBC1D3 and CDK6. It is particularly preferred that said gene panel of genes is selected from the group consisting TFF1 and PLAU; TFF1 and PLAU and PITX2; PITX2 and TFF1; PITX2 and PLAU. Further preferred is the gene panel of TFF1 and PITX2 for the prediction of disease free survival or metastasis in treated patients.

In a further embodiment the object of the invention is the characterisation of the tumor in terms of aggressiveness. This is achieved by analysis of the methylation patterns of one or more genes taken from the group consisting APC, CSPG2, ERBB2, STK11, S100A2, TFF1, TGFBR2, TP53, TMEFF2, SYK, HSPB1, RASSF1, PSAT1, CGA, ESR2, ONECUT2, WBP11, CYP2D6, CDK6, ELK1, CGB and DAG1, and wherein it is further preferred that the sequence of said genes comprise SEQ ID NOs: 2, 4, 5, 7, 11, 12, 13, 14, 17, 19, 20, 21, 25, 26, 29, 35, 37, 45, 46, 53, 55 and 59, respectively, according to Table 1.

In a preferred embodiment said method is achieved by contacting said nucleic acid sequences in a biological sample obtained from a subject with at least one reagent or a series of reagents, wherein said reagent or series of reagents, distinguishes between methylated and non methylated CpG dinucleotides within the target nucleic acid.

In a preferred embodiment, the method comprises the following steps: Preferably, said method comprises the following steps: In the first step, a sample of the tissue to be analysed is obtained. The source may be any suitable source, such as cell lines, histological slides, paraffin embedded tissues, biopsies, tissue embedded in paraffin, bodily fluids, urine, blood and all possible combinations thereof. In a particularly preferred embodiment of the method said source is bodily fluids urine, or blood. The DNA is then isolated from the sample. Extraction may be by means that are standard to one skilled in the art, including the use of commercially available kits, detergent lysates, sonification and vortexing with glass beads. Briefly, wherein the DNA of interest is encapsulated by a cellular membrane the biological sample must be disrupted and lysed by enzymatic, chemical or mechanical means. The DNA solution may then be cleared of proteins and other contaminants e.g. by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA. Once the nucleic acids have been extracted, the genomic double stranded DNA is used in the analysis.

In the second step of the method, the genomic DNA sample is treated in such a manner that cytosine bases which are unmethylated at the 5'-position are converted to uracil, thymine, or another base which is dissimilar to cytosine in terms of hybridization behavior. This will be understood as 'pretreatment' herein.

The above-described treatment of genomic DNA is preferably carried out with bisulfite (hydrogen sulfite, disulfite) and subsequent alkaline hydrolysis that results in a conversion of non-methylated cytosine nucleobases to uracil or to another base that is dissimilar to cytosine in terms of base pairing behavior.

In the third step of the method, fragments of the pretreated DNA are amplified, using sets of primer oligonucleotides according to the present invention, and an amplification enzyme. The amplification of several DNA segments can be carried out simultaneously in one and the same reaction vessel. Typically, the amplification is carried out using a polymerase chain reaction (PCR). The set of primer oligonucleotides includes at least two oligonucleotides whose sequences are each reverse complementary, identical, or hybridize under stringent or highly stringent conditions to an at least 16-base-pair long segment of the base sequences of one or more of SEQ ID NO 206 to 449 and sequences complementary thereto.

In an alternate embodiment of the method, the methylation status of preselected CpG positions within the nucleic acid sequences comprising one or more of SEQ ID NO 1 to 61 may be detected by use of methylation-specific primer oligonucleotides. This technique (MSP) has been described in U.S. Pat. No. 6,265,171 to Herman. The use of methylation status specific primers for the amplification of bisulfite treated DNA allows the differentiation between methylated and unmethylated nucleic acids. MSP primers pairs contain at least one primer that hybridizes to a bisulfite treated CpG dinucleotide. Therefore, the sequence of said primers comprises at least one CpG dinucleotide. MSP primers specific for non-methylated DNA contain a "T" at the 3' position of the C position in the CpG. Preferably, therefore, the base sequence of said primers is required to comprise a sequence having a length of at least 9 nucleotides which hybridizes to a pretreated nucleic acid sequence according to one of SEQ ID NO 206-449 and sequences complementary thereto, wherein the base sequence of said oligomers comprises at least one CpG dinucleotide.

Wherein the method is for the prediction of probability of disease free survival and/or response to a treatment which targets the estrogen receptor pathway or are involved in estrogen metabolism, production or secretion it is particularly preferred that said nucleotide sequence(s) hybridizes to a pretreated nucleic acid sequence according to one of SEQ ID NO 70, 71, 192, 193, 72, 73, 194, 195, 84, 85, 206, 207, 94, 95, 216, 217, 96, 97, 218, 219, 100, 101, 222, 223, 106, 107, 228, 229, 116, 117, 238, 239, 92, 93, 214, 215, 122, 123, 244, 245, 126, 127, 248, 249, 130, 131, 252, 253, 132, 133, 254, 255, 134, 135, 256, 257, 146, 147, 268, 269, 148, 149, 270, 271, 152, 153, 274, 275, 154, 155, 276, 277, 158, 159, 280, 281, 162, 163, 284 and 285 said contiguous nucleotides comprising at least one CpG, TpG or CpA dinucleotide sequence.

Wherein the method is for the characterisation of the breast cell proliferative disorder in terms of aggressiveness it is particularly preferred that said nucleotide sequence(s) hybridizes to a pretreated nucleic acid sequence according to one of SEQ ID NO 64, 65, 186, 187, 68, 69, 190, 191, 70, 71, 192, 193, 74, 75, 196, 197, 82, 83, 204, 205, 84, 85, 206, 207, 86, 87, 208, 209, 88, 89, 210, 211, 94, 95, 216, 217, 98, 99, 220, 221, 100, 101, 222, 223, 102, 103, 224, 225, 110, 111, 232, 233, 112, 113, 234, 235, 118, 119, 240, 241, 130, 131, 252, 253, 134, 135, 256, 257, 150, 151, 272, 273, 152, 153, 274, 275, 166, 167, 288, 289, 170, 171, 292, 293, 178, 179, 300, 301, 148, 149, 270, 271, 150, 151, 272, 273, 152, 153, 274, 275, 154, 155, 276, 277, 156, 157, 278, 279, 158, 159, 280, 281, 160, 161, 282, 283, 162, 163, 284, 285, 164, 165, 286, 287, 166, 167, 288, 289, 168, 169, 290, 291, 170, 171, 292, 293, 172, 173, 294, 295, 174, 175, 296, 297, 176, 177, 298, 299, 178, 179, 300, 301, 180, 181, 302, 303, 182, 183, 304 and 305, said contiguous nucleotides comprising at least one CpG, TpG or CpA dinucleotide sequence.

A further preferred embodiment of the method comprises the use of blocker oligonucleotides. The use of such blocker oligonucleotides has been described by Yu et al., *BioTechniques* 23:714-720, 1997. Blocking probe oligonucleotides are hybridized to the bisulfite treated nucleic acid concurrently with the PCR primers. PCR amplification of the nucleic acid is terminated at the 5' position of the blocking probe, such that amplification of a nucleic acid is suppressed where the complementary sequence to the blocking probe is present. The probes may be designed to hybridize to the bisulfite treated nucleic acid in a methylation status specific manner. For example, for detection of methylated nucleic acids within a population of unmethylated nucleic acids, suppression of the amplification of nucleic acids which are unmethylated at the position in question would be carried out by the use of blocking probes comprising a 'CpA' or 'TpA' at the position in question, as opposed to a 'CpG' if the suppression of amplification of methylated nucleic acids is desired.

For PCR methods using blocker oligonucleotides, efficient disruption of polymerase-mediated amplification requires that blocker oligonucleotides not be elongated by the polymerase. Preferably, this is achieved through the use of blockers that are 3'-deoxyoligonucleotides, or oligonucleotides derivatized at the 3' position with other than a "free" hydroxyl group. For example, 3'-O-acetyl oligonucleotides are representative of a preferred class of blocker molecule.

Additionally, polymerase-mediated decomposition of the blocker oligonucleotides should be precluded. Preferably, such preclusion comprises either use of a polymerase lacking 5'-3' exonuclease activity, or use of modified blocker oligonucleotides having, for example, thioate bridges at the 5'-termini thereof that render the blocker molecule nuclease-resistant. Particular applications may not require such 5' modifications of the blocker. For example, if the blocker- and primer-binding sites overlap, thereby precluding binding of the primer (e.g., with excess blocker), degradation of the blocker oligonucleotide will be substantially precluded. This is because the polymerase will not extend the primer toward, and through (in the 5'-3' direction) the blocker—a process that normally results in degradation of the hybridized blocker oligonucleotide.

A particularly preferred blocker/PCR embodiment, for purposes of the present invention and as implemented herein, comprises the use of peptide nucleic acid (PNA) oligomers as blocking oligonucleotides. Such PNA blocker oligomers are ideally suited, because they are neither decomposed nor extended by the polymerase. Preferably, therefore, the base sequence of said blocking oligonucleotides is required to comprise a sequence having a length of at least 9 nucleotides which hybridizes to a pretreated nucleic acid sequence according to one of SEQ ID NO 206-449, and sequences complementary thereto, wherein the base sequence of said oligonucleotides comprises at least one CpG, TpG or CpA dinucleotide.

Wherein the method is for the prediction of probability of disease free survival and/or response to a treatment which targets the estrogen receptor pathway or are involved in estrogen metabolism, production or secretion it is particularly preferred that said nucleotide sequence(s) hybridizes to a pretreated nucleic acid sequence according to one of SEQ ID NO 70, 71, 192, 193, 72, 73, 194, 195, 84, 85, 206, 207, 94, 95, 216, 217, 96, 97, 218, 219, 100, 101, 222, 223, 106, 107, 228, 229, 116, 117, 238, 239, 92, 93, 214, 215, 122, 123, 244, 245, 126, 127, 248, 249, 130, 131, 252, 253, 132, 133, 254, 255, 134, 135, 256, 257, 146, 147, 268, 269, 148, 149, 270, 271, 152, 153, 274, 275, 154, 155, 276, 277, 158, 159, 280, 281, 162, 163, 284 and 285, said contiguous nucleotides comprising at least one CpG, TpG or CpA dinucleotide sequence.

Wherein the method is for the characterisation of the breast cell proliferative disorder in terms of aggressiveness it is particularly preferred that said nucleotide sequence(s) hybridizes to a pretreated nucleic acid sequence according to one of SEQ ID NO 64, 65, 186, 187, 68, 69, 190, 191, 70, 71, 192, 193, 74, 75, 196, 197, 82, 83, 204, 205, 84, 85, 206, 207, 86, 87, 208, 209, 88, 89, 210, 211, 94, 95, 216, 217, 98, 99, 220, 221, 100, 101, 222, 223, 102, 103, 224, 225, 110, 111, 232, 233, 112, 113, 234, 235, 118, 119, 240, 241, 130, 131, 252, 253, 134, 135, 256, 257, 150, 151, 272, 273, 152, 153, 274, 275, 166, 167, 288, 289, 170, 171, 292, 293, 178, 179, 300, 301, 148, 149, 270, 271, 150, 151, 272, 273, 152, 153, 274, 275, 154, 155, 276, 277, 156, 157, 278, 279, 158, 159, 280, 281, 160, 161, 282, 283, 162, 163, 284, 285, 164, 165, 286, 287, 166, 167, 288, 289, 168, 169, 290, 291, 170, 171, 292, 293, 172, 173, 294, 295, 174, 175, 296, 297, 176, 177, 298, 299, 178, 179, 300, 301, 180, 181, 302, 303, 182, 183, 304 and 305, said contiguous nucleotides comprising at least one CpG, TpG or CpA dinucleotide sequence.

The fragments obtained by means of the amplification can carry a directly or indirectly detectable label. Preferred are labels in the form of fluorescence labels, radionuclides, or detachable molecule fragments having a typical mass that can be detected in a mass spectrometer. Where said labels are mass labels, it is preferred that the labeled amplificates have a single positive or negative net charge, allowing for better detectability in the mass spectrometer. The detection may be carried out and visualized by means of, e.g., matrix assisted laser desorption/ionization mass spectrometry (MALDI) or using electron spray mass spectrometry (ESI). Matrix Assisted Laser Desorption/Ionization Mass Spectrometry (MALDI-TOF) is a very efficient development for the analysis of biomolecules (Karas and Hillenkamp, *Anal Chem.*, 60:2299-301, 1988). An analyte is embedded in a light-absorbing matrix. The matrix is evaporated by a short laser pulse thus transporting the analyte molecule into the vapour phase in an unfragmented manner. The analyte is ionized by collisions with matrix molecules. An applied voltage accelerates the ions into a field-free flight tube. Due to their different masses, the ions are accelerated at different rates. Smaller ions reach the detector sooner than bigger ones. MALDI-TOF spectrometry is well suited to the analysis of peptides and proteins. The analysis of nucleic acids is somewhat more difficult (Gut and Beck, *Current Innovations and Future Trends*, 1:147-57, 1995). The sensitivity with respect to nucleic acid analysis is approximately 100-times less than for peptides, and decreases disproportionally with increasing fragment size. Moreover, for nucleic acids having a multiply negatively charged backbone, the ionization process via the matrix is considerably less efficient. In MALDI-TOF spectrometry, the selection of the matrix plays an eminently important role. For desorption of peptides, several very efficient matrixes have been found which produce a very fine crystallisation. There are now several responsive matrixes for DNA, however, the difference in sensitivity between peptides and nucleic acids has not been reduced. This difference in sensitivity can be reduced, however, by chemically modifying the DNA in such a manner that it becomes more similar to a peptide. For example, phosphorothioate nucleic acids, in which the usual phosphates of the backbone are substituted with thiophosphates, can be converted into a charge-neutral DNA using simple alkylation chemistry (Gut and Beck, *Nucleic Acids Res.* 23: 1367-73, 1995). The coupling of a charge tag to this modified DNA results in an increase in MALDI-TOF sensitivity to the same level as that found for peptides. A further advantage of charge tagging is the increased stability of the analysis against impurities, which makes the detection of unmodified substrates considerably more difficult.

In the fourth step of the method, the amplificates obtained during the third step of the method are analysed in order to ascertain the methylation status of the CpG dinucleotides prior to the treatment.

In embodiments where the amplificates were obtained by means of MSP amplification, the presence or absence of an amplificate is in itself indicative of the methylation state of the CpG positions covered by the primer, according to the base sequences of said primer.

Amplificates obtained by means of both standard and methylation specific PCR may be further analyzed by means of hybridization-based methods such as, but not limited to, array technology and probe based technologies as well as by means of techniques such as sequencing and template directed extension.

In one embodiment of the method, the amplificates synthesised in step three are subsequently hybridized to an array or a set of oligonucleotides and/or PNA probes. In this context, the hybridization takes place in the following manner: the set of probes used during the hybridization is preferably composed of at least 2 oligonucleotides or PNA-oligomers; in the process, the amplificates serve as probes which hybridize to oligonucleotides previously bonded to a solid phase; the non-hybridized fragments are subsequently removed; said oligonucleotides contain at least one base sequence having a length of at least 9 nucleotides which is reverse complementary or identical to a segment of the base sequences specified in the present Sequence Listing; and the segment comprises at least one CpG, TpG or CpA dinucleotide.

In a preferred embodiment, said dinucleotide is present in the central third of the oligomer. For example, wherein the oligomer comprises one CpG dinucleotide, said dinucleotide is preferably the fifth to ninth nucleotide from the 5'-end of a 13-mer. One oligonucleotide exists for the analysis of each CpG dinucleotide within the sequence according to SEQ ID NO 1 to 61, and the equivalent positions within SEQ ID NO 206-449 (according to Table 1). Said oligonucleotides may also be present in the form of peptide nucleic acids. The non-hybridized amplificates are then removed. The hybridized amplificates are then detected. In this context, it is preferred that labels attached to the amplificates are identifiable at each position of the solid phase at which an oligonucleotide sequence is located.

In yet a further embodiment of the method, the genomic methylation status of the CpG positions may be ascertained by means of oligonucleotide probes that are hybridised to the bisulfite treated DNA concurrently with the PCR amplification primers (wherein said primers may either be methylation specific or standard).

A particularly preferred embodiment of this method is the use of fluorescence-based Real Time Quantitative PCR (Heid et al., *Genome Res.* 6:986-994, 1996; also see U.S. Pat. No. 6,331,393) employing a dual-labeled fluorescent oligonucleotide probe (TaqMan™ PCR, using an ABI Prism 7700 Sequence Detection System, Perkin Elmer Applied Biosystems, Foster City, Calif.). The TaqMan™ PCR reaction employs the use of a nonextendible interrogating oligonucleotide, called a TaqMan™ probe, which, in preferred embodiments, is designed to hybridize to a GpC-rich sequence located between the forward and reverse amplification primers. The TaqMan™ probe further comprises a fluorescent "reporter moiety" and a "quencher moiety" covalently bound to linker moieties (e.g., phosphoramidites) attached to the nucleotides of the TaqMan™ oligonucleotide. For analysis of methylation within nucleic acids subsequent to bisulfite treatment, it is required that the probe be methylation specific, as described in U.S. Pat. No. 6,331,393, (hereby incorporated by reference in its entirety) also known as the MethylLight™ assay. Variations on the TaqMan™ detection methodology that are also suitable for use with the described invention include the use of dual-probe technology (Lightcycler™) or fluorescent amplification primers (Sunrise™ technology). Both these techniques may be adapted in a manner suitable for use with bisulfite treated DNA, and moreover for methylation analysis within CpG dinucleotides.

A further suitable method for the use of probe oligonucleotides for the assessment of methylation by analysis of bisulfite treated nucleic acids In a further preferred embodiment of the method, the fifth step of the method comprises the use of template-directed oligonucleotide extension, such as MS-SNuPE as described by Gonzalgo and Jones, *Nucleic Acids Res.* 25:2529-2531, 1997.

In yet a further embodiment of the method, the fifth step of the method comprises sequencing and subsequent sequence analysis of the amplificate generated in the third step of the method (Sanger F., et al., *Proc Natl Acad Sci USA* 74:5463-5467, 1977).

In one preferred embodiment of the method the nucleic acids according to SEQ ID NO 1 to 61, are isolated and treated according to the first three steps of the method outlined above, namely:

a) obtaining, from a subject, a biological sample having subject genomic DNA;
b) extracting or otherwise isolating the genomic DNA; and
c) treating the genomic DNA of b), or a fragment thereof, with one or more reagents to convert cytosine bases that are unmethylated in the 5-position thereof to uracil or to another base that is detectably dissimilar to cytosine in terms of hybridization properties;

and wherein the subsequent amplification of d) is carried out in a methylation specific manner, namely by use of methylation specific primers or blocking oligonucleotides, and further wherein the detection of the amplificates is carried out by means of a real-time detection probes, as described above.

Wherein the subsequent amplification of d) is carried out by means of methylation specific primers, as described above, said methylation specific primers comprise a sequence having a length of at least 9 nucleotides which hybridizes to a pretreated nucleic acid sequence according to one of SEQ ID NO 206-449, and sequences complementary thereto, wherein the base sequence of said oligomers comprises at least one CpG dinucleotide.

Wherein the method is for the prediction of disease free survival and/or probability of response to a treatment which targets the estrogen receptor pathway or are involved in estrogen metabolism, production or secretion it is particularly preferred that said blocking oligonucleotide nucleotide sequence(s) hybridizes to a pretreated nucleic acid sequence according to one of one of SEQ ID NO 70, 71, 192, 193, 72, 73, 194, 195, 84, 85, 206, 207, 94, 95, 216, 217, 96, 97, 218, 219, 100, 101, 222, 223, 106, 107, 228, 229, 116, 117, 238, 239, 92, 93, 214, 215, 122, 123, 244, 245, 126, 127, 248, 249, 130, 131, 252, 253, 132, 133, 254, 255, 134, 135, 256, 257, 146, 147, 268, 269, 148, 149, 270, 271, 152, 153, 274, 275, 154, 155, 276, 277, 158, 159, 280, 281, 162, 163, 284 and 285, said contiguous nucleotides comprising at least one CpG, TpG or CpA dinucleotide sequence.

Wherein the method is for the characterisation of the breast cell proliferative disorder in terms of aggressiveness it is particularly preferred that said blocking oligonucleotide nucleotide sequence(s) hybridizes to a pretreated nucleic acid sequence according to one of SEQ ID NO 64, 65, 186, 187, 68, 69, 190, 191, 70, 71, 192, 193, 74, 75, 196, 197, 82, 83, 204, 205, 84, 85, 206, 207, 86, 87, 208, 209, 88, 89, 210, 211, 94, 95, 216, 217, 98, 99, 220, 221, 100, 101, 222, 223, 102, 103, 224, 225, 110, 111, 232, 233, 112, 113, 234, 235, 118, 119, 240, 241, 130, 131, 252, 253, 134, 135, 256, 257, 150, 151, 272, 273, 152, 153, 274, 275, 166, 167, 288, 289, 170, 171, 292, 293, 178, 179, 300, 301, 148, 149, 270, 271, 150, 151, 272, 273, 152, 153, 274, 275, 154, 155, 276, 277, 156, 157, 278, 279, 158, 159, 280, 281, 160, 161, 282, 283, 162, 163, 284, 285, 164, 165, 286, 287, 166, 167, 288, 289, 168, 169, 290, 291, 170, 171, 292, 293, 172, 173, 294, 295, 174, 175, 296, 297, 176, 177, 298, 299, 178, 179, 300, 301, 180, 181, 302, 303, 182, 183, 304 and 305, said contiguous nucleotides comprising at least one CpG, TpG or CpA dinucleotide sequence.

Step e) of the method, namely the detection of the specific amplificates indicative of the methylation status of one or more CpG positions according to SEQ ID NO 1 to 61 is carried out by means of real-time detection methods as described above.

In an alternative most preferred embodiment of the method the subsequent amplification of d) is carried out in the presence of blocking oligonucleotides, as described above. Said blocking oligonucleotides comprising a sequence having a length of at least 9 nucleotides which hybridizes to a pretreated nucleic acid sequence according to one of SEQ ID NO 206-449 and sequences complementary thereto, wherein the base sequence of said oligomers comprises at least one CpG, TpG or CpA dinucleotide. Step e) of the method, namely the detection of the specific amplificates indicative of the methylation status of one or more CpG positions according to SEQ ID NO 206-449 is carried out by means of real-time detection methods as described above.

In a further preferred embodiment of the method the nucleic acids according to SEQ ID NO 1 to 61 are isolated and treated according to the first three steps of the method outlined above, namely:

a) obtaining, from a subject, a biological sample having subject genomic DNA;

b) extracting or otherwise isolating the genomic DNA;

c) treating the genomic DNA of b), or a fragment thereof, with one or more reagents to convert cytosine bases that are unmethylated in the 5-position thereof to uracil or to another base that is detectably dissimilar to cytosine in terms of hybridization properties; and wherein d) amplifying subsequent to treatment in c) is carried out in a methylation specific manner, namely by use of methylation specific primers or blocking oligonucleotides, and further wherein e) detecting of the amplificates is carried out by means of a real-time detection probes, as described above.

Wherein the subsequent amplification of c) is carried out by means of methylation specific primers, as described above, said methylation specific primers comprise a sequence having a length of at least 9 nucleotides which hybridizes to a pretreated nucleic acid sequence according to one of SEQ ID NO 206-449 and sequences complementary thereto, wherein the base sequence of said oligomers comprises at least one CpG dinucleotide. Wherein the method is for the prediction of disease free survival and/or probability of response to a treatment which targets the estrogen receptor pathway or are involved in estrogen metabolism, production or secretion it is particularly preferred that said methylation specific primers hybridize to a pretreated nucleic acid sequence according to one of one of SEQ ID NO 70, 71, 192, 193, 72, 73, 194, 195, 84, 85, 206, 207, 94, 95, 216, 217, 96, 97, 218, 219, 100, 101, 222, 223, 106, 107, 228, 229, 116, 117, 238, 239, 92, 93, 214, 215, 122, 123, 244, 245, 126, 127, 248, 249, 130, 131, 252, 253, 132, 133, 254, 255, 134, 135, 256, 257, 146, 147, 268, 269, 148, 149, 270, 271, 152, 153, 274, 275, 154, 155, 276, 277, 158, 159, 280, 281, 162, 163, 284 and 285, said contiguous nucleotides comprising at least one CpG, TpG or CpA dinucleotide sequence.

Wherein the method is for the characterisation of the breast cell proliferative disorder in terms of aggressiveness it is particularly preferred that said methylation specific primers hybridize to a pretreated nucleic acid sequence according to one of SEQ ID NO 64, 65, 186, 187, 68, 69, 190, 191, 70, 71, 192, 193, 74, 75, 196, 197, 82, 83, 204, 205, 84, 85, 206, 207, 86, 87, 208, 209, 88, 89, 210, 211, 94, 95, 216, 217, 98, 99, 220, 221, 100, 101, 222, 223, 102, 103, 224, 225, 110, 111, 232, 233, 112, 113, 234, 235, 118, 119, 240, 241, 130, 131, 252, 253, 134, 135, 256, 257, 150, 151, 272, 273, 152, 153, 274, 275, 166, 167, 288, 289, 170, 171, 292, 293, 178, 179, 300, 301, 148, 149, 270, 271, 150, 151, 272, 273, 152, 153, 274, 275, 154, 155, 276, 277, 156, 157, 278, 279, 158, 159, 280, 281, 160, 161, 282, 283, 162, 163, 284, 285, 164, 165, 286, 287, 166, 167, 288, 289, 168, 169, 290, 291, 170, 171, 292, 293, 172, 173, 294, 295, 174, 175, 296, 297, 176, 177, 298, 299, 178, 179, 300, 301, 180, 181, 302, 303, 182, 183, 304 and 305, said contiguous nucleotides comprising at least one CpG, TpG or CpA dinucleotide sequence.

Additional embodiments of the invention provide a method for the analysis of the methylation status of genomic DNA according to the invention (SEQ ID NO 1 to 61), and complements thereof) without the need for pretreatment.

Wherein the method is for the prediction of disease free survival and/or probability of response to a treatment which targets the estrogen receptor pathway or are involved in estrogen metabolism, production or secretion it is particularly preferred that said genomic sequences are selected from SEQ ID NO 5, 6, 12, 17, 18, 20, 23, 28, 16, 31, 33, 35, 36, 37, 43, 44, 46, 47, 49 and 51.

Wherein the method is for the characterisation of the breast cell proliferative disorder in terms of aggressiveness it is particularly preferred that said genomic sequences are selected from SEQ ID NO 2, 4, 5, 7, 11, 12, 13, 14, 17, 19, 20, 21, 25, 26, 29, 35, 37, 45, 46, 53, 55 and 59.

In the first step of such additional embodiments, the genomic DNA sample is isolated from tissue or cellular sources. Preferably, such sources include cell lines, histological slides, paraffin embedded tissues, body fluids, or tissue embedded in paraffin. In the second step, the genomic DNA is extracted. Extraction may be by means that are standard to one skilled in the art, including but not limited to the use of detergent lysates, sonification and vortexing with glass beads. Once the nucleic acids have been extracted, the genomic double-stranded DNA is used in the analysis.

In a preferred embodiment, the DNA may be cleaved prior to the treatment, and this may be by any means standard in the state of the art, in particular with methylation-sensitive restriction endonucleases.

In the third step, the DNA is then digested with one or more methylation sensitive restriction enzymes. The digestion is carried out such that hydrolysis of the DNA at the restriction site is informative of the methylation status of a specific CpG dinucleotide.

In the fourth step, which is optional but a preferred embodiment, the restriction fragments are amplified. This is preferably carried out using a polymerase chain reaction, and said amplificates may carry suitable detectable labels as discussed above, namely fluorophore labels, radionucleotides and mass labels.

In the fifth step the amplificates are detected. The detection may be by any means standard in the art, for example, but not limited to, gel electrophoresis analysis, hybridization analysis, incorporation of detectable tags within the PCR products, DNA array analysis, MALDI or ESI analysis.

When the methylation status of the selected CpG positions have been ascertained patient treatment relevant parameters can be ascertained wherein hypermethylation of the genes is associated with poor prognosis of said subject, aggressive characteristics of said cell proliferative disorder, poor disease free survival and/or lower probability of response of said subject to said treatment as relative to individuals with hypomethylation.

The term "hypermethylation" refers to the average methylation state corresponding to an increased (above average or median) presence of 5-mCyt at one or a plurality of CpG dinucleotides within a DNA sequence of a test DNA sample, relative to the amount of 5-mCyt found at corresponding CpG dinucleotides within a control DNA sample.

The term "hypomethylation" refers to the average methylation state corresponding to a decreased (below average or median) presence of 5-mCyt at one or a plurality of CpG dinucleotides within a DNA sequence of a test DNA sample, relative to the amount of 5-mCyt found at corresponding CpG dinucleotides within a control DNA sample.

Kits

Moreover, an additional aspect of the present invention is a kit comprising, for example: a bisulfite-containing reagent; a set of primer oligonucleotides containing at least two oligonucleotides whose sequences in each case correspond, are complementary, or hybridize under stringent or highly stringent conditions to a 16-base long segment of the sequences SEQ ID NO: 1 to 61 and 206-449; oligonucleotides and/or PNA-oligomers; as well as instructions for carrying out and evaluating the described method. In a further preferred embodiment, said kit may further comprise standard reagents for performing a CpG position-specific methylation analysis, wherein said analysis comprises one or more of the following techniques: MS-SNuPE, MSP, MethyLight™, HeavyMethyl™, COBRA, and nucleic acid sequencing. However, a kit along the lines of the present invention can also contain only part of the aforementioned components.

Typical reagents (e.g., as might be found in a typical MethyLight® based kit) for MethyLight® analysis may include, but are not limited to: PCR primers for specific gene (or methylation-altered DNA sequence or CpG island); TaqMan® probes; optimised PCR buffers and deoxynucleotides; and Taq polymerase.

Typical reagents (e.g., as might be found in a typical Ms-SNuPE-based kit) for Ms-SNuPE analysis may include, but are not limited to: PCR primers for specific gene (or methylation-altered DNA sequence or CpG island); optimised PCR buffers and deoxynucleotides; gel extraction kit; positive control primers; Ms-SNuPE primers for specific gene; reaction buffer (for the Ms-SNuPE reaction); and radioactive nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

Typical reagents (e.g., as might be found in a typical MSP-based kit) for MSP analysis may include, but are not limited to: methylated and unmethylated PCR primers for specific gene (or methylation-altered DNA sequence or CpG island), optimized PCR buffers and deoxynucleotides, and specific probes.

In order to enable the disclosed method, the invention further provides the modified DNA of one or a combination of genes taken from the group EGR4, APC, CDKN2A, CSPG2, ERBB2, STMN1, STK11, CA9, PAX6, SFN, S100A2, TFF1, TGFBR2, TP53, TP73, PLAU, TMEFF2, ESR1, SYK, HSPB1, RASSF1, TES, GRIN2D, PSAT1, CGA, CYP2D6, COX7A2L, ESR2, PLAU, VTN, SULT1A1, PCAF, PRKCD, ONECUT2, BCL6, WBP11, (MX1)MX1, APP, ORC4L, NETO1, TBC1D3, GRB7, CDK6, SEQ ID NO: 47, SEQ ID NO: 48, ABCA8, SEQ ID NO: 50, SEQ ID NO: 51, MARK2, ELK1, Q8WUT3, CGB, BSG, BCKDK, SOX8, DAG1, SEMA4B and ESR1 (exon8) as well as oligonucleotides and/or PNA-oligomers for detecting cytosine methylations within said genes. The present invention is based on the discovery that genetic and epigenetic parameters and, in particular, the cytosine methylation patterns of said genomic DNAs are particularly suitable for improved treatment and monitoring of breast cell proliferative disorders.

The nucleic acids according to the present invention can be used for the analysis of genetic and/or epigenetic parameters of genomic DNA.

This objective according to the present invention is achieved using a nucleic acid containing a sequence of at least 16 bases in length of the pretreated genomic DNA according to one of SEQ ID NO: 206 to SEQ ID NO: 449 and sequences complementary thereto.

The modified nucleic acids could heretofore not be connected with the improved treatment of breast cell proliferative disorders by prediction of disease free survival and/or probability of response to treatment and/or characterisation of the disease in terms of aggressiveness.

The object of the present invention is further achieved by an oligonucleotide or oligomer for the analysis of pretreated DNA, for detecting the genomic cytosine methylation state, said oligonucleotide containing at least one base sequence having a length of at least 10 nucleotides which hybridises to a pretreated genomic DNA according to SEQ ID NO: 206 to SEQ ID NO: 449. The oligomer probes according to the present invention constitute important and effective tools which, for the first time, make it possible to ascertain specific genetic and epigenetic parameters during the analysis of biological samples for features associated with a patient's disease free survival and/or response to endocrine treatment. Said oligonucleotides allow the improved treatment and monitoring of breast cell proliferative disorders. The base sequence of the oligomers preferably contains at least one CpG or TpG dinucleotide. The probes may also exist in the form of a PNA (peptide nucleic acid) which has particularly preferred pairing properties. Particularly preferred are oligonucleotides according to the present invention in which the cytosine of the CpG dinucleotide is within the middle third of said oligonucleotide e.g. the $5^{th}$-$9^{th}$ nucleotide from the 5'-end of a 13-mer oligonucleotide; or in the case of PNA-oligomers, it is preferred for the cytosine of the CpG dinucleotide to be the $4^{th}$-$6^{th}$ nucleotide from the 5'-end of the 9-mer.

The oligomers according to the present invention are normally used in so called "sets" which contain up to two oligomers and up to one oligomer for each of the CpG dinucleotides within SEQ ID NO: 206 to SEQ ID NO: 449.

In the case of the sets of oligonucleotides according to the present invention, it is preferred that at least one oligonucleotide is bound to a solid phase. It is further preferred that all the oligonucleotides of one set are bound to a solid phase.

The present invention further relates to a set of at least 2 n (oligonucleotides and/or PNA-oligomers) used for detecting the cytosine methylation state of genomic DNA, by analysis of said sequence or treated versions of said sequence (of the genes EGR4, APC, CDKN2A, CSPG2, ERBB2, STMN1, STK11, CA9, PAX6, SFN, S100A2, TFF1, TGFBR2, TP53, TP73, PLAU, TMEFF2, ESR1, SYK, HSPB1, RASSF1, TES, GRIN2D, PSAT1, CGA, CYP2D6, COX7A2L, ESR2, PLAU, VTN, SULT1A1, PCAF, PRKCD, ONECUT2, BCL6, WBP11, (MX1)MX1, APP, ORC4L, NETO1, TBC1D3, GRB7, CDK6, SEQ ID NO: 47, SEQ ID NO: 48, ABCA8, SEQ ID NO: 50, SEQ ID NO: 51, MARK2, ELK1, Q8WUT3, CGB, BSG, BCKDK, SOX8, DAG1, SEMA4B, ESR1 (exon8) as detailed in the sequence listing and Table 1) and sequences complementary thereto). These probes enable improved treatment and monitoring of breast cell proliferative disorders.

It will be obvious to one skilled in the art that the method according to the invention will be improved and supplemented by the incorporation of markers and clinical indicators known in the state of the art and currently used as predictive of the outcome of therapies which target endocrine or endocrine associated pathways. More preferably said markers include node status, age, menopausal status, grade, estrogen and progesterone receptors.

The genes that form the basis of the present invention may be used to form a "gene panel", i.e. a collection comprising the particular genetic sequences of the present invention and/ or their respective informative methylation sites. The formation of gene panels allows for a quick and specific analysis of specific aspects of breast cancer treatment. The gene panel(s) as described and employed in this invention can be used with surprisingly high efficiency for the treatment of breast cell proliferative disorders by prediction of the outcome of treatment with a therapy comprising one or more drugs which target the estrogen receptor pathway or are involved in estrogen metabolism, production, or secretion. The analysis of each gene of the panel contributes to the evaluation of patient responsiveness, however, in a less preferred embodiment the patient evaluation may be achieved by analysis of only a single gene. The analysis of a single member of the 'gene panel' would enable a cheap but less accurate means of evaluating patient responsiveness, the analysis of multiple members of the panel would provide a rather more expensive means of carrying out the method, but with a higher accuracy (the technically preferred solution).

The efficiency of the method according to the invention is improved when applied to patients who have not been treated with chemotherapy. Accordingly, it is a particularly preferred embodiment of the method wherein the method is used for the assessment of subjects who have not undergone chemotherapy.

According to the present invention, it is preferred that an arrangement of different oligonucleotides and/or PNA-oligomers (a so-called "array") made available by the present invention is present in a manner that it is likewise bound to a solid phase. This array of different oligonucleotide- and/or PNA-oligomer sequences can be characterised in that it is arranged on the solid phase in the form of a rectangular or hexagonal lattice. The solid phase surface is preferably composed of silicon, glass, polystyrene, aluminium, steel, iron, copper, nickel, silver, or gold. However, nitrocellulose as well as plastics such as nylon which can exist in the form of pellets or also as resin matrices are suitable alternatives.

Therefore, a further subject matter of the present invention is a method for manufacturing an array fixed to a carrier material for the improved treatment and monitoring of breast cell proliferative disorders. In said method at least one oligomer according to the present invention is coupled to a solid phase. Methods for manufacturing such arrays are known, for example, from U.S. Pat. No. 5,744,305 by means of solid-phase chemistry and photolabile protecting groups.

A further subject matter of the present invention relates to a DNA chip for the improved treatment and monitoring of breast cell proliferative disorders. The DNA chip contains at least one nucleic acid according to the present invention. DNA chips are known, for example, in U.S. Pat. No. 5,837,832.

The oligomers according to the present invention or arrays thereof as well as a kit according to the present invention are intended to be used for the improved treatment and monitoring of breast cell proliferative disorders. According to the present invention, the method is preferably used for the analysis of important genetic and/or epigenetic parameters within genomic DNA, in particular for use in improved treatment and monitoring of breast cell proliferative disorders.

The methods according to the present invention are used, for improved treatment and monitoring of breast cell proliferative disorder by enabling more informed therapeutic regimens.

The present invention moreover relates to the diagnosis and/or prognosis of events which are disadvantageous or relevant to patients or individuals in which important genetic and/or epigenetic parameters within genomic DNA, said parameters obtained by means of the present invention may be compared to another set of genetic and/or epigenetic parameters, the differences serving as the basis for the diagnosis and/or prognosis of events which are disadvantageous or relevant to patients or individuals.

In the context of the present invention the term "hybridisation" is to be understood as a bond of an oligonucleotide to a completely complementary sequence along the lines of the Watson-Crick base pairings in the sample DNA, forming a duplex structure.

In the context of the present invention, "genetic parameters" are mutations and polymorphisms of genomic DNA and sequences further required for their regulation. To be designated as mutations are, in particular, insertions, deletions, point mutations, inversions and polymorphisms and, particularly preferred, SNPs (single nucleotide polymorphisms).

In the context of the present invention the term "methylation state" is taken to mean the degree of methylation present in a nucleic acid of interest, this may be expressed in absolute or relative terms i.e. as a percentage or other numerical value or by comparison to another tissue and therein described as hypermethylated, hypomethylated or as having significantly similar or identical methylation status.

In the context of the present invention the term "regulatory region" of a gene is taken to mean nucleotide sequences which affect the expression of a gene. Said regulatory regions may be located within, proximal or distal to said gene. Said regulatory regions include but are not limited to constitutive promoters, tissue-specific promoters, developmental-specific promoters, inducible promoters and the like. Promoter regulatory elements may also include certain enhancer sequence elements that control transcriptional or translational efficiency of the gene.

In the context of the present invention the term "chemotherapy" is taken to mean the use of drugs or chemical substances to treat cancer. This definition excludes radiation therapy (treatment with high energy rays or particles), hormone therapy (treatment with hormones or hormone analogues (synthetic substitutes) and surgical treatment.

In the context of the present invention, "epigenetic parameters" are, in particular, cytosine methylations and further modifications of DNA bases of genomic DNA and sequences further required for their regulation. Further epigenetic parameters include, for example, the acetylation of histones which, cannot be directly analysed using the described method but which, in turn, correlates with the DNA methylation.

In the context of the present invention the term "adjuvant treatment" is taken to mean a therapy of a cancer patient immediately following an initial non chemotherapeutical therapy, e.g. surgery. In general, the purpose of an adjuvant therapy is to provide a significantly smaller risk of recurrences compared without the adjuvant therapy.

In the context of the present invention the terms "estrogen receptor positive" and/or "progesterone receptor positive" when used to describe a breast cell proliferative disorder are taken to mean that the proliferating cells expresses said hormone receptor.

BEST MODE

Characterization of a breast cancer in terms of prognosis and/or treatment outcome enables the physician to make an informed decision as to a therapeutic regimen with appropriate risk and benefit trade off's to the patient.

In the context of the present mode of the invention the terms "estrogen receptor positive" and/or "progesterone receptor positive" when used to describe a breast cell proliferative disorder are taken to mean that the proliferating cells express said hormone receptor.

In the context of the present mode of the invention the term 'aggressiveness' is taken to mean one or more of high likelihood of relapse post surgery; below average or below median patient survival; below average or below median disease free survival; below average or below median relapse-free survival; above average tumor-related complications; fast progression of tumor or metastases. According to the aggressiveness of the disease an appropriate treatment or treatments may be selected from the group consisting of chemotherapy, radiotherapy, surgery, biological therapy, immunotherapy, antibody treatments, treatments involving molecularly targeted drugs, estrogen receptor modulator treatments, estrogen receptor down-regulator treatments, aromatase inhibitors treatments, ovarian ablation, treatments providing LHRH analogues or other centrally acting drugs influencing estrogen production. Wherein a cancer is characterized as 'aggressive' it is particularly preferred that a treatment such as, but not limited to, chemotherapy is provided in addition to or instead of an endocrine targeting therapy. Indicators of tumor aggressiveness standard in the art include but are not limited to, tumor stage, tumor grade, nodal status and survival.

Unless stated otherwise as used herein the term "survival" shall be taken to include all of the following: survival until mortality, also known as overall survival (wherein said mortality may be either irrespective of cause or breast tumor related); "recurrence-free survival" (wherein the term recurrence shall include both localized and distant recurrence); metastasis free survival; disease free survival (wherein the term disease shall include breast cancer and diseases associated therewith). The length of said survival may be calculated by reference to a defined start point (e.g. time of diagnosis or start of treatment) and end point (e.g. death, recurrence or metastasis).

As used herein the term "prognostic marker" shall be taken to mean an indicator of the likelihood of progression of the disease, in particular aggressiveness and metastatic potential of a breast tumor.

As used herein the term 'predictive marker' shall be taken to mean an indicator of response to therapy, said response is preferably defined according to patient survival. It is preferably used to define patients with high, low and intermediate length of survival or recurrence after treatment, that is the result of the inherent heterogeneity of the disease process.

As defined herein the term predictive marker may in some situations fall within the remit of a herein described 'prognostic marker', for example, wherein a prognostic marker differentiates between patients with different survival outcomes pursuant to a treatment, said marker is also a predictive marker for said treatment. Therefore, unless otherwise stated the two terms shall not be taken to be mutually exclusive.

As used herein the term 'expression' shall be taken to mean the transcription and translation of a gene, as well as the genetic or the epigenetic modifications of the genomic DNA associated with the marker gene and/or regulatory or promoter regions thereof. Genetic modifications include SNPs, point mutations, deletions, insertions, repeat length, rearrangements and other polymorphisms. The analysis of either the expression levels of protein, or mRNA or the analysis of the patient's individual genetic or epigenetic modification of the marker gene are herein summarized as the analysis of 'expression of the gene.

The level of expression of a gene may be determined by the analysis of any factors associated with or indicative of the level of transcription and translation of a gene including but not limited to methylation analysis, loss of heterozygosity (hereinafter also referred to as LOH), RNA expression levels and protein expression levels.

Furthermore the activity of the transcribed gene may be affected by genetic variations such as but not limited to genetic modifications (including but not limited to SNPs, point mutations, deletions, insertions, repeat length, rearrangements and other polymorphisms).

The terms "endocrine therapy" or "endocrine treatment" are meant to comprise any therapy, treatment or treatments targeting the estrogen receptor pathway or estrogen synthesis pathway or estrogen conversion pathway, which is involved in estrogen metabolism, production or secretion. Said treatments include, but are not limited to estrogen receptor modulators, estrogen receptor down-regulators, aromatase inhibitors, ovarian ablation, LHRH analogues and other centrally acting drugs influencing estrogen production.

The term "monotherapy" shall be taken to mean the use of a single drug or other therapy.

In the context of the present mode of the invention the term "chemotherapy" is taken to mean the use of pharmaceutical or chemical substances to treat cancer. This definition excludes radiation therapy (treatment with high energy rays or particles), hormone therapy (treatment with hormones or hormone analogues) and surgical treatment.

In the context of the present mode of the invention the term "adjuvant treatment" is taken to mean a therapy of a cancer patient immediately following an initial non chemotherapeutical therapy, e.g. surgery. In general, the purpose of an adjuvant therapy is to decrease the risk of recurrence.

In the context of the present mode of the invention the term "determining a suitable treatment regimen for the subject" is taken to mean the determination of a treatment regimen (i.e. a single therapy or a combination of different therapies that are used for the prevention and/or treatment of the cancer in the patient) for a patient that is started, modified and/or ended based or essentially based or at least partially based on the results of the analysis according to the present mode of the invention. One example is starting an adjuvant endocrine therapy after surgery, another would be to modify the dosage of a particular chemotherapy. The determination can, in addition to the results of the analysis according to the present mode of the invention, be based on personal characteristics of the subject to be treated. In most cases, the actual determination of the suitable treatment regimen for the subject will be performed by the attending physician or doctor.

In the context of this mode of the invention the terms "obtaining a biological sample" or "obtaining a sample from a subject", shall not be taken to include the active retrieval of a sample from an individual, e.g. the performance of a biopsy. Said terms shall be taken to mean the obtainment of a sample previously isolated from an individual. Said samples may be isolated by any means standard in the art, including but not limited to biopsy, surgical removal, body fluids isolated by means of aspiration. Furthermore said samples may be provided by third parties including but not limited to clinicians, couriers, commercial sample providers and sample collections.

In the context of the present mode of the invention, the term "CpG island" refers to a contiguous region of genomic DNA that satisfies the criteria of (1) having a frequency of CpG dinucleotides corresponding to an "Observed/Expected Ratio">0.6, and (2) having a "GC Content">0.5. CpG islands are typically, but not always, between about 0.2 to about 1 kb in length.

In the context of the present mode of the invention the term "regulatory region" of a gene is taken to mean nucleotide sequences which affect the expression of a gene. Said regulatory regions may be located within, proximal or distal to said gene. Said regulatory regions include but are not limited to constitutive promoters, tissue-specific promoters, developmental-specific promoters, inducible promoters and the like. Promoter regulatory elements may also include certain enhancer sequence elements that control transcriptional or translational efficiency of the gene.

In the context of the present mode of the invention, the term "methylation" refers to the presence or absence of 5-methylcytosine ("5-mCyt") at one or a plurality of CpG dinucleotides within a DNA sequence.

In the context of the present mode of the invention the term "methylation state" is taken to mean the degree of methylation present in a nucleic acid of interest, this may be expressed in absolute or relative terms i.e. as a percentage or other numerical value or by comparison to another tissue and therein described as hypermethylated, hypomethylated or as having significantly similar or identical methylation status.

In the context of the present mode of the invention, the term "hemi-methylation" or "hemimethylation" refers to the methylation state of a CpG methylation site, where only a single cytosine in one of the two CpG dinucleotide sequences of the double stranded CpG methylation site is methylated (e.g., 5'-NNC$^M$GNN-3' (top strand): 3'-NNGCNN-5' (bottom strand)).

In the context of the present mode of the invention, the term "hypermethylation" refers to the average methylation state corresponding to an increased presence of 5-mCyt at one or a plurality of CpG dinucleotides within a DNA sequence of a test DNA sample, relative to the amount of 5-mCyt found at corresponding CpG dinucleotides within a normal control DNA sample.

In the context of the present mode of the invention, the term "hypomethylation" refers to the average methylation state corresponding to a decreased presence of 5-mCyt at one or a plurality of CpG dinucleotides within a DNA sequence of a test DNA sample, relative to the amount of 5-mCyt found at corresponding CpG dinucleotides within a normal control DNA sample.

In the context of the present mode of the invention, the term "microarray" refers broadly to both "DNA microarrays," and 'DNA chip(s),' as recognized in the art, encompasses all art-recognized solid supports, and encompasses all methods for affixing nucleic acid molecules thereto or synthesis of nucleic acids thereon.

"Genetic parameters" are mutations and polymorphisms of genes and sequences further required for their regulation. To be designated as genetic modifications or mutations are, in particular, insertions, deletions, point mutations, inversions and polymorphisms and, particularly preferred, SNPs (single nucleotide polymorphisms).

"Epigenetic modifications" or "epigenetic parameters" are modifications of DNA bases of genomic DNA and sequences further required for their regulation, in particular, cytosine methylations thereof. Further epigenetic parameters include, for example, the acetylation of histones which, however, cannot be directly analyzed using the described method but which, in turn, correlate with the DNA methylation.

In the context of the present mode of the invention, the term "bisulfite reagent" refers to a reagent comprising bisulfite, disulfite, hydrogen sulfite or combinations thereof, useful as disclosed herein to distinguish between methylated and unmethylated CpG dinucleotide sequences.

In the context of the present mode of the invention, the term "Methylation assay" refers to any assay for determining the methylation state of one or more CpG dinucleotide sequences within a sequence of DNA.

In the context of the present mode of the invention, the term "MS.AP-PCR" (Methylation-Sensitive Arbitrarily-Primed Polymerase Chain Reaction) refers to the art-recognized technology that allows for a global scan of the genome using CG-rich primers to focus on the regions most likely to contain CpG dinucleotides, and described by Gonzalgo et al., *Cancer Research* 57:594-599, 1997.

In the context of the present mode of the invention, the term "MethyLight" refers to the art-recognized fluorescence-based real-time PCR technique described by Eads et al., *Cancer Res.* 59:2302-2306, 1999.

In the context of the present mode of the invention, the term "HeavyMethyl™" assay, in the embodiment thereof implemented herein, refers to a methylation assay comprising methylation specific blocking probes covering CpG positions between the amplification primers.

The term "Ms-SNuPE" (Methylation-sensitive Single Nucleotide Primer Extension) refers to the art-recognized assay described by Gonzalgo and Jones, *Nucleic Acids Res.* 25:2529-2531, 1997.

In the context of the present mode of the invention the term "MSP" (Methylation-specific PCR) refers to the art-recognized methylation assay described by Herman et al. *Proc. Natl. Acad. Sci. USA* 93:9821-9826, 1996, and by U.S. Pat. No. 5,786,146.

In the context of the present mode of the invention the term "COBRA" (Combined Bisulfite Restriction Analysis) refers to the art-recognized methylation assay described by Xiong and Laird, *Nucleic Acids Res.* 25:2532-2534, 1997.

In the context of the present mode of the invention the term "hybridization" is to be understood as a bond of an oligonucleotide to a complementary sequence along the lines of the Watson-Crick base pairings in the sample DNA, forming a duplex structure.

"Stringent hybridization conditions," as defined herein, involve hybridizing at 68° C. in 5×SSC/5×Denhardt's solution/1.0% SDS, and washing in 0.2×SSC/0.1% SDS at room temperature, or involve the art-recognized equivalent thereof (e.g., conditions in which a hybridization is carried out at 60° C. in 2.5×SSC buffer, followed by several washing steps at 37° C. in a low buffer concentration, and remains stable). Moderately stringent conditions, as defined herein, involve including washing in 3×SSC at 42° C., or the art-recognized equivalent thereof. The parameters of salt concentration and temperature can be varied to achieve the optimal level of identity between the probe and the target nucleic acid. Guidance regarding such conditions is available in the art, for example, by Sambrook et al., 1989, Molecular Cloning, A Laboratory Manual, Cold Spring Harbor Press, N.Y.; and Ausubel et al. (eds.), 1995, Current Protocols in Molecular Biology, (John Wiley and Sons, N.Y.) at Unit 2.10.

"Background DNA" as used herein refers to any nucleic acids which originate from sources other than breast cells.

Using the methods and nucleic acids described herein, statistically significant models of patient relapse, disease free survival, metastasis free survival, overall survival and/or disease progression can be developed and utilized to assist patients and clinicians in determining suitable treatment options to be included in the therapeutic regimen.

In one aspect the method provides a prognostic marker for a cell proliferative disorder of the breast tissues. Preferably this prognosis is provided in terms of an outcome selected from the group consisting of likelihood of relapse; overall patient survival; metastasis free survival; disease free survival or disease progression.

In a further aspect of the invention said marker is used as a predictive marker of outcome of a treatment which targets the estrogen receptor pathway or is involved in estrogen metabolism, production or secretion as a therapy for patients suffering from a cell proliferative disorder of the breast tissues. This aspect of the method enables the physician to determine which treatments may be used in addition to or instead of said endocrine treatment. It is preferred that said additional treatment is a more aggressive therapy such as, but not limited to, chemotherapy. Thus, the present invention will be seen to reduce the problems associated with present breast cell proliferative disorder prognostic, predictive and treatment response prediction methods.

Using the methods and nucleic acids as described herein, patient survival can be evaluated before or during treatment for a cell proliferative disorder of the breast tissues, in order to provide critical information to the patient and clinician as to the likely progression of the disease. It will be appreciated, therefore, that the methods and nucleic acids exemplified herein can serve to improve a patient's quality of life and odds of treatment success by allowing both patient and clinician a more accurate assessment of the patient's treatment options.

The herein disclosed method may be used for the improved treatment of all breast cell proliferative disorder patients, both pre- and post-menopausal and independent of their node or estrogen receptor status. However, it is particularly preferred that said patients are node-negative and estrogen receptor positive.

The present invention makes available a method for the improved treatment of breast cell proliferative disorders, by enabling the improved prediction of a patient's survival, in particular by predicting the likelihood of relapse post-surgery both with or without adjuvant endocrine treatment. Furthermore, the present invention provides a means for the improved prediction of treatment outcome with endocrine therapy, wherein said therapy comprises one or more treatments which target the estrogen receptor pathway or are involved in estrogen metabolism, production, or secretion.

The method according to the invention may be used for the analysis of a wide variety of cell proliferative disorders of the breast tissues including, but not limited to, ductal carcinoma in situ, invasive ductal carcinoma, invasive lobular carcinoma, lobular carcinoma in situ, comedocarcinoma, inflammatory carcinoma, mucinous carcinoma, scirrhous carcinoma, colloid carcinoma, tubular carcinoma, medullary carcinoma, metaplastic carcinoma, and papillary carcinoma and papillary carcinoma in situ, undifferentiated or anaplastic carcinoma and Paget's disease of the breast.

The method according to the invention may be used to provide a prognosis of breast cell proliferative disorder patients, furthermore said method may be used to provide a prediction of patient survival and/or relapse following treatment by endocrine therapy.

Wherein the herein disclosed markers, methods and nucleic acids are used as prognostic markers it is particularly preferred that said prognosis is defined in terms of patient survival and/or relapse. In this embodiment patients survival times and/or relapse are predicted according to their gene expression or genetic or epigenetic modifications thereof. In this aspect of the invention it is particularly preferred that said patients are tested prior to receiving any adjuvant endocrine treatment.

Wherein the herein disclosed markers, methods and nucleic acids are used as predictive markers it is particularly preferred that the method is applied to predict the outcome of patients who receive endocrine treatment as secondary treatment to an initial non chemotherapeutical therapy, e.g. surgery (hereinafter referred to as the 'adjuvant setting') as illustrated in FIG. 1. Such a treatment is often prescribed to patients suffering from Stage 1 to 3 breast carcinomas. It is also preferred that said 'outcome' is defined in terms of patients survival and/or relapse.

In this embodiment patients survival times and/or relapse are predicted according to their gene expression or genetic or epigenetic modifications thereof. By detecting patients with below average or below median metastasis free survival or disease free survival times and/or high likelihood of relapse the physician may choose to recommend the patient for further treatment, instead of or in addition to the endocrine targeting therapy(s), in particular but not limited to, chemotherapy.

The herein described invention provides a novel breast cell proliferative disorder prognostic and predictive biomarker.

It is herein described that aberrant expression of the gene PITX2 and/or regulatory or promoter regions thereof is correlated to prognosis and/or prediction of outcome of estrogen treatment of breast cell proliferative disorder patients, in particular breast carcinoma.

This marker thereby provides a novel means for the characterization of breast cell proliferative disorders. As described herein determination of the expression of the gene PITX2 and/or regulatory or promoter regions thereof enables the prediction of prognosis of a patient with a proliferative disorder of the breast tissues. In an alternative embodiment the expression of the gene PITX2 and/or regulatory or promoter regions thereof enables the prediction of treatment response of a patient treated with one or more treatments which target the estrogen receptor, synthesis or conversion pathways or are otherwise involved in estrogen metabolism, production or secretion.

The herein described invention is thereby useful for the differentiation of individuals who may be appropriately treated with one or more treatments which target the estrogen receptor pathway or are involved in estrogen metabolism, production or secretion from those individuals, who would be optimally treated with other treatments in addition to said treatment. Preferred 'other treatments' include but are not limited to chemotherapy or radiotherapy. It is particularly preferred that said prognosis and/or treatment response is stated in terms of likelihood of relapse, survival or outcome.

In a further embodiment of the invention the aberrant expression of a plurality of genes comprising the gene PITX2 and/or regulatory or promoter regions thereof is analyzed. Said plurality of genes is hereinafter also referred to as a 'gene panel'. The analysis of multiple genes increases the accuracy of a provided prognosis and/or prediction of estrogen treatment outcome. It is preferred that the gene panel consists of up to seven genes and/or their promoter regions associated with prognosis and/or prediction of treatment response of breast carcinoma patients. It is further preferred that said panel consists of the gene PITX2 and one or more genes selected from the group consisting of ABCA8, CDK6, ERBB2, ONECUT2, PLAU, TBC1D3 and TFF1 and/or regulatory regions thereof. It is particularly preferred that the gene panel is selected from the group of gene panels consisting of:

PITX2, PLAU and TFF1
PITX2 and PLAU
PITX2 and TFF1

It is particularly preferred that the gene panel consisting PITX2 and TFF1 is used to predict outcome of treatment of patients with an endocrine treatment. It is particularly preferred that the gene panel consisting PITX2 and PLAU is used to provide a prognosis of patients. It is preferred that said patients are analyzed prior to receiving any endocrine treatment.

In further embodiments this invention relates to new methods and sequences for the prognosis of patients diagnosed with breast cell proliferative disease. In a further aspect the invention relates to new methods and sequences, which may be used as tools for the selection of suitable treatments of patients diagnosed with breast cell proliferative disease based on a prediction of likelihood of relapse, survival or outcome.

More specifically this invention provides new methods and sequences for patients diagnosed with breast cell proliferative disease, allowing the improved selection of suitable adjuvant therapy. Furthermore, it is preferred that patients with poor prognosis following endocrine monotherapy are provided with chemotherapy in addition to or instead of an endocrine therapy.

One aspect of the invention is the provision of methods for providing a prognosis and/or prediction of outcome of endocrine treatment of a patient with a cell proliferative disorder of the breast tissues. Preferably said prognosis and/or prediction is provided in terms of likelihood of relapse or the survival of said patient. It is further preferred that said survival is disease free survival or metastasis free survival. It is also preferred that said disease is breast cancer. These methods comprise the analysis of the expression levels of the gene PITX2 and/or regulatory regions thereof.

In further embodiments the method comprises analysis of the expression of a 'gene panel' comprising the gene PITX2 and one or more genes selected from the group consisting of ABCA8, CDK6, ERBB2, ONECUT2, PLAU, TBC1D3 and TFF1 and/or regulatory regions thereof. It is particularly preferred that said gene panels are selected from the group of gene panels consisting of:

PITX2, PLAU and TFF1
PITX2 and PLAU
PITX2 and TFF1

It is particularly preferred that the expression of the gene panel consisting PITX2 and TFF1 is determined in order to predict outcome of treatment of patients with an endocrine treatment. It is also particularly preferred that the expression of the gene panel consisting PITX2 and PLAU is determined in order to provide a prognosis of patients. It is preferred that said patients are analyzed prior to receiving any endocrine treatment.

Determination of expression may be achieved by any means standard in the art, however it is most preferably achieved by analysis of LOH, methylation, protein expression, mRNA expression, genetic or other epigenetic modifications of the genomic sequences.

Especially preferred is the analysis of the DNA methylation profile of the genomic sequence of the gene PITX2 and/or regulatory or promoter regions thereof as given in SEQ ID NO: 1130. Further preferred is the analysis of the methylation status of CpG positions within the following sections of SEQ ID NO: 1130 nucleotide 2,700-nucleotide 3,000; nucleotide 3,900-nucleotide 4,200; nucleotide 5,500-nucleotide 8,000; nucleotide 13,500-nucleotide 14,500; nucleotide 16,500-nucleotide 18,000; nucleotide 18,500-nucleotide 19,000; nucleotide 21,000-nucleotide 22,500. Especially preferred is the analysis of the methylation status of eight specific CpG dinucleotides, covered in the four sub-sequences of said SEQ ID NO: 1130 given in SEQ ID NOs: 23, 1140-1142. Wherein the method comprises analysis of a gene panel comprising the PITX2 and one or more genes selected from the group consisting ABCA8, CDK6, ERBB2, ONECUT2, PLAU, TBC1D3 and TFF1 and/or regulatory or promoter regions thereof it is preferred that the sequence of said genes is selected from the group consisting of SEQ ID NO: 49, SEQ ID NO: 46, SEQ ID NO: 5, SEQ ID NO: 35, SEQ ID NO: 16, SEQ ID NO: 43, SEQ ID NO: 12 AND SEQ ID NO: 1131 according to Table 1.

This methodology presents further improvements over the state of the art in that the method may be applied to any subject, independent of the estrogen and/or progesterone receptor status. Therefore in a preferred embodiment, the subject is not required to have been tested for estrogen or progesterone receptor status.

In further aspects of the invention, the disclosed matter provides novel nucleic acid sequences useful for the analysis of methylation within said gene, other aspects provide novel uses of the gene and the gene product as well as methods, assays and kits directed to providing a prognosis and/or predicting outcome of endocrine treatment of a patient diagnosed with breast cell proliferative disease.

In one embodiment the invention discloses a method for providing the prognosis and/or predicting outcome of endocrine treatment of a patient suffering from a breast cell proliferative disease, by analysis of expression of the gene PITX2 and/or regulatory regions thereof. Preferably said endocrine treatment is an adjuvant endocrine monotherapy. Said method may be enabled by means of any analysis of the expression of the gene, including but not limited to mRNA expression analysis or protein expression analysis or by analysis of its genetic modifications leading to an altered expression (including LOH). However, in the most preferred embodiment of the invention, said expression is determined by means of analysis of the methylation status of CpG sites within the gene PITX2 and its promoter or regulatory elements.

In one embodiment of the method aberrant expression of the gene PITX2 and/or panels thereof may be detected by analysis of loss of heterozygosity of the gene. In a first step genomic DNA is isolated from a biological sample of the patient's tumor. The isolated DNA is then analyzed for LOH by any means standard in the art including but not limited to amplification of the gene locus or associated microsatellite markers. Said amplification may be carried out by any means standard in the art including polymerase chain reaction (PCR), strand displacement amplification (SDA) and isothermal amplification.

The level of amplificate is then detected by any means known in the art including but not limited to gel electrophoresis and detection by probes (including Real Time PCR). Furthermore the amplificates may be labeled in order to aid said detection. Suitable detectable labels include but are not limited to fluorescence label, radioactive labels and mass labels the suitable use of which shall be described herein.

The detection of a decreased amount of an amplificate corresponding to one of the amplified alleles in a test sample as relative to that of a heterozygous control sample is indicative of LOH.

To detect the levels of mRNA encoding PITX2 and/or panels comprising said gene in a detection system for breast cancer relapse, a sample is obtained from a patient. Said obtaining of a sample is preferably not meant to be retrieving of a sample, as in performing a biopsy, but rather directed to the availability of an isolated biological material representing a specific tissue, relevant for the intended use. The sample can be a tumor tissue sample from the surgically removed tumor, a biopsy sample as taken by a surgeon and provided to the analyst or a sample of blood, plasma, serum or the like. The sample may be treated to extract the nucleic acids contained therein. The resulting nucleic acid from the sample is subjected to gel electrophoresis or other separation techniques. Detection involves contacting the nucleic acids and in particular the mRNA of the sample with a DNA sequence serving as a probe to form hybrid duplexes. The stringency of hybridization is determined by a number of factors during hybridization and during the washing procedure, including temperature, ionic strength, length of time and concentration of formamide. These factors are outlined in, for example, Sambrook et al. (Molecular Cloning: A Laboratory Manual, 2nd ed., 1989). Detection of the resulting duplex is usually accomplished by the use of labeled probes. Alternatively, the probe may be unlabeled, but may be detectable by specific binding with a ligand which is labeled, either directly or indirectly. Suitable labels and methods for labeling probes and ligands are known in the art, and include, for example, radioactive labels which may be incorporated by known methods (e.g., nick translation or kinasing), biotin, fluorescent groups, chemiluminescent groups (e.g., dioxetanes, particularly triggered dioxetanes), enzymes, antibodies, and the like.

In order to increase the sensitivity of the detection in a sample of mRNA encoding PITX2 and/or panels comprising said gene, the technique of reverse transcription/polymerization chain reaction can be used to amplify cDNA transcribed from mRNA encoding PITX2 and/or panels comprising said gene. The method of reverse transcription/PCR is well known in the art (for example, see Watson and Fleming, supra).

The reverse transcription/PCR method can be performed as follows. Total cellular RNA is isolated by, for example, the standard guanidium isothiocyanate method and the total RNA is reverse transcribed. The reverse transcription method involves synthesis of DNA on a template of RNA using a reverse transcriptase enzyme and a 3' end primer. Typically, the primer contains an oligo(dT) sequence. The cDNA thus produced is then amplified using the PCR method and PITX2 and/or panels comprising said gene specific primers. (Belyavsky et al, Nucl Acid Res 17:2919-2932, 1989; Krug and Berger, Methods in Enzymology, Academic Press, N.Y., Vol. 152, pp. 316-325, 1987 which are incorporated by reference)

The present invention may also be described in certain embodiments as a kit for use in predicting the likelihood of relapse and/or survival of a breast cancer patient before or after surgical tumor removal with or without adjuvant endocrine monotherapy state through testing of a biological sample. A representative kit may comprise one or more nucleic acid segments as described above that selectively hybridize to PITX2 mRNA and/or mRNA from genes of a panel comprising said PITX2 gene, and a container for each of the one or more nucleic acid segments. In certain embodiments the nucleic acid segments may be combined in a single tube. In further embodiments, the nucleic acid segments may also include a pair of primers for amplifying the target mRNA. Such kits may also include any buffers, solutions, solvents, enzymes, nucleotides, or other components for hybridization, amplification or detection reactions. Preferred kit components include reagents for reverse transcription-PCR, in situ hybridization, Northern analysis and/or RPA.

The present invention further provides for methods to detect the presence of the polypeptide(s) of, PITX2 and/or panels comprising said protein, in a sample obtained from a patient. It is preferred that said sequence is essentially the same as the sequence as given in FIG. 107. Any method known in the art for detecting proteins can be used. Such methods include, but are not limited to immunodiffusion, immunoelectrophoresis, immunochemical methods, binder-ligand assays, immunohistochemical techniques, agglutination and complement assays. (for example see Basic and Clinical Immunology, Sites and Terr, eds., Appleton and Lange, Norwalk, Conn. pp 217-262, 1991 which is incorporated by reference). Preferred are binder-ligand immunoassay methods including reacting antibodies with an epitope or epitopes of PITX2 and/or panels thereof and competitively displacing a labeled PITX2 protein and/or panels thereof or derivatives thereof.

Certain embodiments of the present invention comprise the use of antibodies specific to the polypeptide encoded by the gene PITX2 and/or panels comprising said gene. Such antibodies may be useful for providing a prognosis of the likelihood of relapse and/or survival of a breast cancer patient preferably under adjuvant endocrine monotherapy by comparing a patient's levels of PITX2 marker expression and/or the expression of panels comprising PITX2 to expression of the same marker(s) in normal individuals. In certain embodiments the production of monoclonal or polyclonal antibodies can be induced by the use of the PITX2 and/or other polypeptides of the panels as antigene. Such antibodies may in turn be used to detect expressed proteins as markers for prognosis of relapse of a breast cancer patient under adjuvant endocrine monotherapy. The levels of such proteins present in the peripheral blood of a patient may be quantified by conventional methods. Antibody-protein binding may be detected and quantified by a variety of means known in the art, such as labeling with fluorescent or radioactive ligands. The invention further comprises kits for performing the above-mentioned procedures, wherein such kits contain antibodies specific for the PITX2 and/or panels thereof polypeptides.

Numerous competitive and non-competitive protein binding immunoassays are well known in the art. Antibodies employed in such assays may be unlabeled, for example as used in agglutination tests, or labeled for use a wide variety of assay methods. Labels that can be used include radionuclides, enzymes, fluorescers, chemiluminescers, enzyme substrates or co-factors, enzyme inhibitors, particles, dyes and the like for use in radioimmunoassay (RIA), enzyme immunoassays, e.g., enzyme-linked immunosorbent assay (ELISA), fluorescent immunoassays and the like. Polyclonal or monoclonal antibodies to PITX2 and/or panels thereof or an epitope thereof can be made for use in immunoassays by any of a number of methods known in the art. One approach for preparing antibodies to a protein is the selection and preparation of an amino acid sequence of all or part of the protein, chemically synthesising the sequence and injecting it into an appropriate animal, usually a rabbit or a mouse (Milstein and Kohler Nature 256:495-497, 1975; Gulfre and Milstein, Methods in Enzymology: Immunochemical Techniques 73:1-46, Langone and Banatis eds., Academic Press, 1981 which are incorporated by reference). Methods for preparation of PITX2 and/or panels thereof or an epitope thereof include, but are not limited to chemical synthesis, recombinant DNA techniques or isolation from biological samples.

In one aspect the invention provides significant improvements over the state of the art in that it is the first single marker that can be used to predict the likelihood of relapse or of survival of a breast cancer patient under adjuvant endocrine monotherapy.

In the most preferred embodiment of the invention the analysis of expression is carried out by means of methylation analysis. It is further preferred that the methylation state of the CpG dinucleotides within the genomic sequence according to SEQ ID NO: 1130 and sequences complementary thereto is analyzed. SEQ ID NO: 1130 discloses the gene PITX2 and its promoter and regulatory elements thereof, wherein said fragment comprises CpG dinucleotides exhibiting a prognosis and/or predicting outcome of endocrine treatment specific methylation pattern. Further preferred is the analysis of the methylation status of CpG positions within the following sections of SEQ ID NO: 1130 nucleotide 2,700-nucleotide 3,000; nucleotide 3,900-nucleotide 4,200; nucleotide 5,500-nucleotide 8,000; nucleotide 13,500-nucleotide 14,500; nucleotide 16,500-nucleotide 18,000; nucleotide 18,500-nucleotide 19,000; nucleotide 21,000-nucleotide 22,500. Also preferred is the analysis of the sub-sequence of the gene PITX2 as shown in SEQ ID NO: 23.

Wherein the method comprises analysis of the expression of a 'gene panel' comprising the gene and/or regulatory or promoter regions thereof and one or more genes selected from the group consisting ABCA8, CDK6, ERBB2, ONECUT2, PLAU, TBC1D3 and TFF1 it is almost preferred that said analysis of expression is carried out by means of methylation analysis. It is particularly preferred that the CpG methylation of the gene panels selected from the group of gene panels consisting:
  PITX2, PLAU and TFF1
  PITX2 and PLAU
  PITX2 and TFF1
is analyzed.

It is particularly preferred that the methylation of the gene panel consisting PITX2 and TFF1 is determined in order to predict outcome of treatment of patients with an endocrine treatment. It is also particularly preferred that the methylation of the gene panel consisting PITX2 and PLAU is determined in order to provide a prognosis of patients. It is preferred that said patients are analyzed prior to receiving any endocrine treatment.

Hypermethylation of PITX2 and selected other genes as herein and/or sequences thereof are associated with poor prognosis and/or outcome of endocrine treatment of breast cell proliferative disorders, most preferably breast carcinoma.

The methylation pattern of the gene PITX2 and its promoter and regulatory elements have heretofore not been analyzed with regard to prognosis or prediction of outcome of endocrine treatment of a patient diagnosed with a breast cell proliferative disorder. Due to the degeneracy of the genetic code, the sequence as identified in SEQ ID NO: 1130 should be interpreted so as to include all substantially similar and equivalent sequences upstream of the promoter region of a gene which encodes a polypeptide with the biological activity of that encoded by PITX2.

Most preferably, the following method is used to detect methylation within the gene PITX2 and/or regulatory or promoter regions thereof wherein said methylated nucleic acids are present in an excess of background DNA, wherein the background DNA is present in 100 to 1000 times the concentration of the DNA to be detected.

The method for the analysis of methylation comprises contacting a nucleic acid sample obtained from a subject with at least one reagent or a series of reagents, wherein said reagent or series of reagents, distinguishes between methylated and non-methylated CpG dinucleotides within the target nucleic acid.

Preferably, said method comprises the following steps: In the first step, a sample of the tissue to be analyzed is obtained. The source may be any suitable source, preferably, the source of the sample is selected from the group consisting of histological slides, biopsies, paraffin-embedded tissue, bodily fluids, plasma, serum, stool, urine, blood, nipple aspirate and combinations thereof. Preferably, the source is tumor tissue, biopsies, serum, urine, blood or nipple aspirate. The most preferred source, is the tumor sample, surgically removed from the patient or a biopsy sample of said patient.

The DNA is then isolated from the sample. Genomic DNA may be isolated by any means standard in the art, including the use of commercially available kits. Briefly, wherein the DNA of interest is encapsulated in/by a cellular membrane the biological sample must be disrupted and lysed by enzymatic, chemical or mechanical means. The DNA solution may then be cleared of proteins and other contaminants e.g. by digestion with proteinase K. The genomic DNA is then recovered from the solution. This may be carried out by means of a variety of methods including salting out, organic extraction or binding of the DNA to a solid phase support. The choice of method will be affected by several factors including time, expense and required quantity of DNA.

The genomic DNA sample is then treated in such a manner that cytosine bases which are unmethylated at the 5'-position are converted to uracil, thymine, or another base which is dissimilar to cytosine in terms of hybridization behavior. This will be understood as "treatment" or "pre-treatment" herein.

The above described pre-treatment of genomic DNA is preferably carried out with bisulfite (hydrogen sulfite, disulfite) and subsequent alkaline hydrolysis which results in a conversion of non-methylated cytosine nucleobases to uracil or to another base which is dissimilar to cytosine in terms of base pairing behavior. Enclosing the DNA to be analyzed in an agarose matrix, thereby preventing the diffusion and renaturation of the DNA (bisulfite only reacts with single-stranded DNA), and replacing all precipitation and purification steps with fast dialysis (Olek A, et al., A modified and improved method for bisulfite based cytosine methylation analysis, *Nucleic Acids Res.* 24:5064-6, 1996) is one preferred example how to perform said pre-treatment. It is further preferred that the bisulfite treatment is carried out in the presence of a radical scavenger or DNA denaturing agent.

The treated DNA is then analyzed in order to determine the methylation state of the gene PITX2 and/or regulatory regions thereof (prior to the treatment) associated with prognosis and/or outcome of endocrine treatment. In a further embodiment of the method the methylation state of the gene PITX2 and/or regulatory regions thereof and the methylation state of one or more genes selected from the group consisting ABCA8, CDK6, ERBB2, ONECUT2, PLAU, TBC1D3 and TFF1 and/or regulatory or promoter regions thereof is determined. It is particularly preferred that methylation status of a gene panel selected from the group of gene panels consisting PITX2, PLAU and TFF1; PITX2 and PLAU; PITX2 and TFF1 is determined. It is further preferred that the sequences of said genes as described in the accompanying sequence listing (see Table 3) are analyzed.

In the third step of the method, fragments of the pretreated DNA are amplified. Wherein the source of the DNA is free DNA from serum, or DNA extracted from paraffin it is particularly preferred that the size of the amplificate fragment is between 100 and 200 base pairs in length, and wherein said DNA source is extracted from cellular sources (e.g. tissues, biopsies, cell lines) it is preferred that the amplificate is between 100 and 350 base pairs in length. It is particularly preferred that said amplificates comprise at least one 20 base pair sequence comprising at least three CpG dinucleotides. Said amplification is carried out using sets of primer oligonucleotides according to the present invention, and a preferably heat-stable polymerase. The amplification of several DNA segments can be carried out simultaneously in one and the same reaction vessel, in one embodiment of the method preferably six or more fragments are amplified simultaneously. Typically, the amplification is carried out using a polymerase chain reaction (PCR). The set of primer oligonucleotides includes at least two oligonucleotides whose sequences are each reverse complementary, identical, or hybridize under stringent or highly stringent conditions to an at least 18-base-pair long segment of the base sequences of SEQ ID NO: 250-251, 372-373, SEQ ID Nos: 302-303, 296-297, 214-215, 274-275, 236-237, 290-291, 228-229, 250-251, 424-425, 418-419, 336-337, 396-397, 358-359, 412-413, 350-351 AND SEQ ID NO: 1132 to SEQ ID NO: 1139 and sequences complementary thereto.

In a preferred embodiment of the method the primers may be selected from the group consisting to SEQ ID NO: 1143 to SEQ ID NO: 1147.

In an alternate embodiment of the method, the methylation status of preselected CpG positions within the nucleic acid sequences comprising SEQ ID NO: 23, SEQ ID NO: 49, SEQ ID NO: 46, SEQ ID NO: 5, SEQ ID NO: 35, SEQ ID NO: 16, SEQ ID NO: 43, SEQ ID NO: 12, SEQ ID NO: 1130 and SEQ ID NO: 1131 may be detected by use of methylation-specific primer oligonucleotides. This technique (MSP) has been described in U.S. Pat. No. 6,265,171 to Herman. The use of methylation status specific primers for the amplification of bisulfite treated DNA allows the differentiation between methylated and unmethylated nucleic acids. MSP primers pairs contain at least one primer which hybridizes to a bisulfite treated CpG dinucleotide. Therefore, the sequence of said primers comprises at least one CpG, TpG or CpA dinucleotide. MSP primers specific for non-methylated DNA contain a "T" at the 3' position of the C position in the CpG. Preferably, therefore, the base sequence of said primers is required to comprise a sequence having a length of at least 18 nucleotides which hybridizes to a pretreated nucleic acid sequence according to SEQ ID NO: 250-251, 372-373 and SEQ ID NO: 1132, 1133, 1136 and 1137 and sequences complementary thereto, wherein the base sequence of said oligomers comprises at least one CpG, tpG or Cpa dinucleotide. In this embodiment of the method according to the invention it is particularly preferred that the MSP primers comprise between 2 and 4 CpG, tpG or Cpa dinucleotides. It is further preferred that said dinucleotides are located within the 3' half of the primer e.g. wherein a primer is 18 bases in length the specified dinucleotides are located within the first 9 bases form the 3' end of the molecule. In addition to the CpG, tpG or Cpa dinucleotides it is further preferred that said primers should further comprise several bisulfite converted bases (i.e. cytosine converted to thymine, or on the hybridizing strand, guanine converted to adenosine). In a further preferred embodiment said primers are designed so as to comprise no more than 2 cytosine or guanine bases.

The fragments obtained by means of the amplification can carry a directly or indirectly detectable label. Preferred are labels in the form of fluorescence labels, radionuclides, or detachable molecule fragments having a typical mass which can be detected in a mass spectrometer. Where said labels are mass labels, it is preferred that the labeled amplificates have a single positive or negative net charge, allowing for better detectability in the mass spectrometer. The detection may be carried out and visualized by means of, e.g., matrix assisted laser desorption/ionization mass spectrometry (MALDI) or using electron spray mass spectrometry (ESI).

Matrix Assisted Laser Desorption/Ionization Mass Spectrometry (MALDI-TOF) is a very efficient development for the analysis of biomolecules (Karas and Hillenkamp, *Anal Chem.*, 60:2299-301, 1988). An analyte is embedded in a light-absorbing matrix. The matrix is evaporated by a short laser pulse thus transporting the analyte molecule into the vapor phase in an unfragmented manner. The analyte is ionized by collisions with matrix molecules. An applied voltage accelerates the ions into a field-free flight tube. Due to their different masses, the ions are accelerated at different rates. Smaller ions reach the detector sooner than bigger ones. MALDI-TOF spectrometry is well suited to the analysis of peptides and proteins. The analysis of nucleic acids is somewhat more difficult (Gut and Beck, *Current Innovations and Future Trends,* 1:147-57, 1995). The sensitivity with respect to nucleic acid analysis is approximately 100-times less than for peptides, and decreases disproportionally with increasing fragment size. Moreover, for nucleic acids having a multiply negatively charged backbone, the ionisation process via the matrix is considerably less efficient. In MALDI-TOF spectrometry, the selection of the matrix plays an eminently important role. For the desorption of peptides, several very efficient matrixes have been found which produce a very fine crystallisation. There are now several responsive matrixes for DNA, however, the difference in sensitivity between peptides and nucleic acids has not been reduced. This difference in sensitivity can be reduced, however, by chemically modifying the DNA in such a manner that it becomes more similar to a peptide. For example, phosphorothioate nucleic acids, in which the usual phosphates of the backbone are substituted with thiophosphates, can be converted into a charge-neutral DNA using simple alkylation chemistry (Gut and Beck, *Nucleic Acids Res.* 23: 1367-73, 1995). The coupling of a charge tag to this modified DNA results in an increase in MALDI-TOF sensitivity to the same level as that found for peptides. A further advantage of charge tagging is the increased stability of the analysis against impurities, which makes the detection of unmodified substrates considerably more difficult.

In a particularly preferred embodiment of the method the amplification of step three is carried out in the presence of at least one species of blocker oligonucleotides. The use of such blocker oligonucleotides has been described by Yu et al., *BioTechniques* 23:714-720, 1997. The use of blocking oligonucleotides enables the improved specificity of the amplification of a sub-population of nucleic acids. Blocking probes hybridized to a nucleic acid suppress, or hinder the polymerase mediated amplification of said nucleic acid. In one embodiment of the method blocking oligonucleotides are designed so as to hybridize to background DNA. In a further embodiment of the method said oligonucleotides are designed so as to hinder or suppress the amplification of unmethylated nucleic acids as opposed to methylated nucleic acids or vice versa.

Blocking probe oligonucleotides are hybridized to the bisulfite treated nucleic acid concurrently with the PCR primers. PCR amplification of the nucleic acid is terminated at the 5' position of the blocking probe, such that amplification of a nucleic acid is suppressed where the complementary sequence to the blocking probe is present. The probes may be designed to hybridize to the bisulfite treated nucleic acid in a methylation status specific manner. For example, for detection of methylated nucleic acids within a population of unmethylated nucleic acids, suppression of the amplification of nucleic acids which are unmethylated at the position in question would be carried out by the use of blocking probes comprising a 'TpG' at the position in question, as opposed to a 'CpG.' In one embodiment of the method the sequence of said blocking oligonucleotides should be identical or complementary to molecule is complementary or identical to a sequence at least 18 base pairs in length selected from the group consisting of SEQ ID NOs: 250-251, 372-373, 1132, 1133, 1136 and 1137 preferably comprising one or more CpG, TpG or CpA dinucleotides. In one embodiment of the method the sequence of said oligonucleotides is selected from the group consisting SEQ ID NO: 1148 and SEQ ID NO: 1149 and sequences complementary thereto.

For PCR methods using blocker oligonucleotides, efficient disruption of polymerase-mediated amplification requires that blocker oligonucleotides not be elongated by the polymerase. Preferably, this is achieved through the use of blockers that are 3'-deoxyoligonucleotides, or oligonucleotides derivatised at the 3' position with other than a "free" hydroxyl group. For example, 3'-O-acetyl oligonucleotides are representative of a preferred class of blocker molecule.

Additionally, polymerase-mediated decomposition of the blocker oligonucleotides should be precluded. Preferably, such preclusion comprises either use of a polymerase lacking 5'-3' exonuclease activity, or use of modified blocker oligonucleotides having, for example, thioate bridges at the 5'-termini thereof that render the blocker molecule nuclease-resistant. Particular applications may not require such 5' modifications of the blocker. For example, if the blocker- and primer-binding sites overlap, thereby precluding binding of the primer (e.g., with excess blocker), degradation of the blocker oligonucleotide will be substantially precluded. This is because the polymerase will not extend the primer toward, and through (in the 5'-3' direction) the blocker—a process that normally results in degradation of the hybridized blocker oligonucleotide.

A particularly preferred blocker/PCR embodiment, for purposes of the present invention and as implemented herein, comprises the use of peptide nucleic acid (PNA) oligomers as blocking oligonucleotides. Such PNA blocker oligomers are ideally suited, because they are neither decomposed nor extended by the polymerase.

In one embodiment of the method, the binding site of the blocking oligonucleotide is identical to, or overlaps with that of the primer and thereby hinders the hybridization of the primer to its binding site. In a further preferred embodiment of the method, two or more such blocking oligonucleotides are used. In a particularly preferred embodiment, the hybridization of one of the blocking oligonucleotides hinders the hybridization of a forward primer, and the hybridization of another of the probe (blocker) oligonucleotides hinders the hybridization of a reverse primer that binds to the amplificate product of said forward primer.

In an alternative embodiment of the method, the blocking oligonucleotide hybridizes to a location between the reverse and forward primer positions of the treated background DNA, thereby hindering the elongation of the primer oligonucleotides.

It is particularly preferred that the blocking oligonucleotides are present in at least 5 times the concentration of the primers.

In the fourth step of the method, the amplificates obtained during the third step of the method are analyzed in order to ascertain the methylation status of the CpG dinucleotides prior to the treatment.

In embodiments where the amplificates are obtained by means of MSP amplification and/or blocking oligonucleotides, the presence or absence of an amplificate is in itself indicative of the methylation state of the CpG positions covered by the primers and or blocking oligonucleotide, according to the base sequences thereof. All possible known molecular biological methods may be used for this detection, including, but not limited to gel electrophoresis, sequencing, liquid chromatography, hybridizations, real time PCR analysis or combinations thereof. This step of the method further acts as a qualitative control of the preceding steps.

In the fourth step of the method amplificates obtained by means of both standard and methylation specific PCR are further analyzed in order to determine the CpG methylation status of the genomic DNA isolated in the first step of the method. This may be carried out by means of hybridization-based methods such as, but not limited to, array technology and probe based technologies as well as by means of techniques such as sequencing and template directed extension.

In one embodiment of the method, the amplificates synthesized in step three are subsequently hybridized to an array or a set of oligonucleotides and/or PNA probes. In this context, the hybridization takes place in the following manner: the set of probes used during the hybridization is preferably composed of at least 2 oligonucleotides or PNA-oligomers; in the process, the amplificates serve as probes which hybridize to oligonucleotides previously bonded to a solid phase; the non-hybridized fragments are subsequently removed; said oligonucleotides contain at least one base sequence having a length of at least 9 nucleotides which is reverse complementary or identical to a segment of the base sequences specified in the SEQ ID NO: 250-251, 372-373 and SEQ ID Nos: 1132, 1133, 1136 and 1137 and the segment comprises at least one CpG, TpG or CpA dinucleotide. In further embodiments said oligonucleotides contain at least one base sequence having a length of at least 9 nucleotides which is reverse complementary or identical to a segment of the base sequences specified in the SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351; and the segment comprises at least one CpG, TpG or CpA dinucleotide.

In a preferred embodiment, said dinucleotide is present in the central third of the oligomer. For example, wherein the oligomer comprises one CpG dinucleotide, said dinucleotide is preferably the fifth to ninth nucleotide from the 5'-end of a 13-mer. In a further embodiment one oligonucleotide exists for the analysis of each CpG dinucleotide within the sequences according to SEQ ID NO: 23 and 1130, and the equivalent positions within SEQ ID NO: 250-251, 372-373 and SEQ ID NO:1132, 1133, 1136 and 1137. One oligonucleotide exists for the analysis of each CpG dinucleotide within the sequence according to SEQ ID NO: 23, SEQ ID NOS. 1130, 1131, AND SEQ ID NO: 49, SEQ ID NO: 46, SEQ ID NO: 5, SEQ ID NO: 35, SEQ ID NO: 16, SEQ ID NO: 43, SEQ ID NO: 12, and the equivalent positions within SEQ ID NO: 250-251, 372-373, SEQ ID NO: 1132 to SEQ ID NO: 1139, AND SEQ ID Nos: 302-303, 296-297, 214-215, 274-275, 236-237, 290-291, 228-229, 250-251, 424-425, 418-419, 336-337, 396-397, 358-359, 412-413, 350-351. Said oligonucleotides may also be present in the form of peptide nucleic acids. The non-hybridized amplificates are then removed. The hybridized amplificates are detected. In this context, it is preferred that labels attached to the amplificates are identifiable at each position of the solid phase at which an oligonucleotide sequence is located.

In yet a further embodiment of the method, the genomic methylation status of the CpG positions may be ascertained by means of oligonucleotide probes that are hybridized to the bisulfite treated DNA concurrently with the PCR amplification primers (wherein said primers may either be methylation specific or standard).

A particularly preferred embodiment of this method is the use of fluorescence-based Real Time Quantitative PCR (Heid et al., *Genome Res.* 6:986-994, 1996; also see U.S. Pat. No. 6,331,393). There are two preferred embodiments of utilizing this method. One embodiment, known as the TaqMan™ assay employs a dual-labeled fluorescent oligonucleotide probe. The TaqMan™ PCR reaction employs the use of a non-extendible interrogating oligonucleotide, called a TaqMan™ probe, which is designed to hybridize to a CpG-rich sequence located between the forward and reverse amplification primers. The TaqMan™ probe further comprises a fluorescent "reporter moiety" and a "quencher moiety" covalently bound to linker moieties (e.g., phosphoramidites) attached to the nucleotides of the TaqMan™ oligonucleotide. Hybridized probes are displaced and broken down by the polymerase of the amplification reaction thereby leading to an increase in fluorescence. For analysis of methylation within nucleic acids subsequent to bisulfite treatment, it is required that the probe be methylation specific, as described in U.S. Pat. No. 6,331, 393, (hereby incorporated by reference in its entirety) also known as the MethyLight assay. The second preferred embodiment of this MethyLight technology is the use of dual-probe technology (Lightcycler®), each probe carrying donor or recipient fluorescent moieties, hybridization of two probes in proximity to each other is indicated by an increase or fluorescent amplification primers. Both these techniques may be adapted in a manner suitable for use with bisulfite treated DNA, and moreover for methylation analysis within CpG dinucleotides.

Also any combination of these probes or combinations of these probes with other known probes may be used.

In a further preferred embodiment of the method, the fourth step of the method comprises the use of template-directed oligonucleotide extension, such as MS-SNuPE as described by Gonzalgo and Jones, *Nucleic Acids Res.* 25:2529-2531, 1997. In said embodiment it is preferred that the methylation specific single nucleotide extension primer (MS-SNuPE primer) is identical or complementary to a sequence at least nine but preferably no more than twenty five nucleotides in length of one or more of the sequences taken from the group of SEQ ID NO: 250-251, 372-373 and SEQ ID Nos: 1132, 1133, 1136 and 1137. However it is preferred to use fluorescently labeled nucleotides, instead of radiolabeled nucleotides.

In yet a further embodiment of the method, the fourth step of the method comprises sequencing and subsequent sequence analysis of the amplificate generated in the third step of the method (Sanger F., et al., *Proc Natl Acad Sci USA* 74:5463-5467, 1977).

In the most preferred embodiment of the methylation analysis method the genomic nucleic acids are isolated and treated according to the first three steps of the method outlined above, namely:

a) obtaining, from a subject, a biological sample having subject genomic DNA;

b) extracting or otherwise isolating the genomic DNA;

c) treating the genomic DNA of b), or a fragment thereof, with one or more reagents to convert cytosine bases that are unmethylated in the 5-position thereof to uracil or to another base that is detectably dissimilar to cytosine in terms of hybridization properties; and wherein d) amplifying subsequent to treatment in c) is carried out in a methylation specific manner, namely by use of methylation specific primers or blocking oligonucleotides, and further wherein e) detecting of the amplificates is carried out by means of a real-time detection probe, as described above.

Preferably, where the subsequent amplification of d) is carried out by means of methylation specific primers, as described above, said methylation specific primers comprise a sequence having a length of at least 9 nucleotides which hybridizes to a treated nucleic acid sequence according to one of SEQ ID NO: 250-251, 372-373 and SEQ ID Nos: 1132, 1133, 1136 and 1137 and sequences complementary thereto, wherein the base sequence of said oligomers comprises at least one CpG dinucleotide. Additionally, further methylation specific primers may also be used for the analysis of a gene panel as described above wherein said primers comprise a sequence having a length of at least 9 nucleotides which hybridizes to a treated nucleic acid sequence according to one of SEQ ID Nos: 302-303, 296-297, 214-215, 274-275, 236-237, 290-291, 228-229, 250-251, 424-425, 418-419, 336-337, 396-397, 358-359, 412-413, 350-351 and SEQ ID Nos: 1134, 1135, 1138 and 1139 and sequences complementary thereto, wherein the base sequence of said oligomers comprises at least one CpG dinucleotide.

In an alternative most preferred embodiment of the method, the subsequent amplification of d) is carried out in the presence of blocking oligonucleotides, as described above. It is particularly preferred that said blocking oligonucleotides comprise a sequence having a length of at least 9 nucleotides which hybridizes to a treated nucleic acid sequence according to one of SEQ ID NO: 250-251, 372-373, SEQ ID Nos: 1132, 1133, 1136 and 1137 and sequences complementary thereto, wherein the base sequence of said oligomers comprises at least one CpG, TpG or CpA dinucleotide.

Additionally, further blocking oligonucleotides may also be used for the analysis of a gene panel as described above wherein said blocking oligonucleotides comprising a sequence having a length of at least 9 nucleotides which hybridizes to a treated nucleic acid sequence according to one of SEQ ID Nos: 302-303, 296-297, 214-215, 274-275, 236-237, 290-291, 228-229, 250-251, 424-425, 418-419, 336-337, 396-397, 358-359, 412-413, 350-351 and SEQ ID Nos: 1134, 1135, 1138 and 1139 and sequences complementary thereto, wherein the base sequence of said oligomers comprises at least one CpG, TpG or CpA dinucleotide.

Step e) of the method, namely the detection of the specific amplificates indicative of the methylation status of one or more CpG positions according to SEQ ID NO: 250-251, 372-373, SEQ ID NO: 1132 to SEQ ID NO: 1139, AND SEQ ID Nos: 302-303, 296-297, 214-215, 274-275, 236-237, 290-291, 228-229, 250-251, 424-425, 418-419, 336-337, 396-397, 358-359, 412-413, 350-351, and most preferably SEQ ID NO: 250-251, 372-373 and SEQ ID Nos: 1132, 1133, 1136 and 1137 is carried out by means of real-time detection methods as described above.

Additional embodiments of the invention provide a method for the analysis of the methylation status of the gene PITX2 and/or regulatory regions thereof without the need for pre-treatment. Furthermore said method may also be used for the methylation analysis of the gene PITX2 and/or regulatory regions thereof and the methylation state of one or more genes selected from the group consisting ABCA8, CDK6, ERBB2, ONECUT2, PLAU, TBC1D3, TFF1 and/or regulatory or promoter regions thereof is determined. It is particularly preferred that methylation status of a gene panel selected from the group of gene panels consisting PITX2, PLAU and TFF1; PITX2 and PLAU; PITX2 and TFF1 is determined.

In the first step of such additional embodiments, the genomic DNA sample is isolated from tissue or cellular sources. Preferably, such sources include cell lines, histological slides, biopsy tissue, body fluids, or breast tumor tissue embedded in paraffin. Extraction may be by means that are standard to one skilled in the art, including but not limited to the use of detergent lysates, sonification and vortexing with glass beads. Once the nucleic acids have been extracted, the genomic double-stranded DNA is used in the analysis.

In a preferred embodiment, the DNA may be cleaved prior to the treatment, and this may be by any means standard in the state of the art, but preferably with methylation-sensitive restriction endonucleases.

In the second step, the DNA is then digested with one or more methylation sensitive restriction enzymes. The digestion is carried out such that hydrolysis of the DNA at the restriction site is informative of the methylation status of a specific CpG dinucleotide.

In the third step, which is optional but a preferred embodiment, the restriction fragments are amplified. This is preferably carried out using a polymerase chain reaction, and said amplificates may carry suitable detectable labels as discussed above, namely fluorophore labels, radionuclides and mass labels.

In the fourth step the amplificates are detected. The detection may be by any means standard in the art, for example, but not limited to, gel electrophoresis analysis, hybridization analysis, incorporation of detectable tags within the PCR products, DNA array analysis, MALDI or ESI analysis.

In the final step of the method the prognosis and/or predicting outcome of endocrine treatment is determined. Preferably, the correlation of the expression level of the genes with the prognosis and/or predicting outcome of endocrine treatment is done substantially without human intervention. Poor prognosis and/or predicting outcome of endocrine treatment is determined by aberrant levels of mRNA and/or protein, and hypermethylation. It is particularly preferred that said hypermethylation is above average or above median of said disease in said specific setting.

It is particularly preferred that the classification of the sample is carried out by algorithmic means.

In one embodiment machine learning predictors are trained on the methylation patterns at the investigated CpG sites of the samples with known status. A selection of the CpG positions which are discriminative for the machine learning predictor are used in the panel. In a particularly preferred embodiment of the method, both methods are combined; that is, the machine learning classifier is trained only on the selected CpG positions that are significantly differentially methylated between the classes according to the statistical analysis.

The development of algorithmic methods for the classification of a sample based on the methylation status of the CpG positions within the panel are demonstrated in the examples.

The disclosed invention provides treated nucleic acids, derived from genomic SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12, wherein the treatment is suitable to convert at least one unmethylated cytosine base of the genomic DNA sequence to uracil or another base that is detectably dissimilar to cytosine in terms of hybridization. The genomic sequences in question may comprise one, or more, consecutive or random methylated CpG positions. Said treatment preferably comprises use of a reagent selected from the group consisting of bisulfite, hydrogen sulfite, disulfite, and combinations thereof. In a preferred embodiment of the invention, the objective comprises analysis of a non-naturally occurring modified nucleic acid comprising a sequence of at least 16 contiguous nucleotide bases in length of a sequence selected from the group consisting of SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12, wherein said sequence comprises at least one CpG, TpA or CpA dinucleotide and sequences complementary thereto. The sequences of SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351 provide non-naturally occurring modified versions of the nucleic acid according to SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12, wherein the modification of each genomic sequence results in the synthesis of a nucleic acid having a sequence that is unique and distinct from said genomic sequence as follows. For each sense strand genomic DNA, e.g., SEQ ID NO: 23, four converted versions are disclosed. A first version wherein "C" to "T," but "CpG" remains "CpG" (i.e., corresponds to case where, for the genomic sequence, all "C" residues of CpG dinucleotide sequences are methylated and are thus not converted); a second version discloses the complement of the disclosed genomic DNA sequence (i.e.

antisense strand), wherein "C" to "T," but "CpG" remains "CpG" (i.e., corresponds to case where, for all "C" residues of CpG dinucleotide sequences are methylated and are thus not converted). The 'unmethylated' converted sequences of SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12 correspond to SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351. A third chemically converted version of each genomic sequences is provided, wherein "C" to "T" for all "C" residues, including those of "CpG" dinucleotide sequences (i.e., corresponds to case where, for the genomic sequences, all "C" residues of CpG dinucleotide sequences are unmethylated); a final chemically converted version of each sequence, discloses the complement of the disclosed genomic DNA sequence (i.e. antisense strand), wherein "C" to "T" for all "C" residues, including those of "CpG" dinucleotide sequences (i.e., corresponds to case where, for the complement (antisense strand) of each genomic sequence, all "C" residues of CpG dinucleotide sequences are unmethylated). The 'downmethylated' converted sequences of SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12 correspond to SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351.

The invention further discloses oligonucleotide or oligomer for detecting the cytosine methylation state within genomic or pre-treated DNA, according to SEQ ID NO: 23, SEQ ID NO:1130 to SEQ ID NO: 1139 AND SEQ ID NO: 49, SEQ ID NO: 46, SEQ ID NO: 5, SEQ ID NO: 35, SEQ ID NO: 16, SEQ ID NO: 43, SEQ ID NO: 12. Said oligonucleotide or oligomer comprising a nucleic acid sequence having a length of at least nine (9) nucleotides which hybridizes, under moderately stringent or stringent conditions (as defined herein above), to a treated nucleic acid sequence according to SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351 and/or sequences complementary thereto, or to a genomic sequence according to SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12 and/or sequences complementary thereto.

Thus, the present invention includes nucleic acid molecules (e.g., oligonucleotides and peptide nucleic acid (PNA) molecules (PNA-oligomers)) that hybridize under moderately stringent and/or stringent hybridization conditions to all or a portion of the sequences SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351, or to the complements thereof. The hybridizing portion of the hybridizing nucleic acids is typically at least 9, 15, 20, 25, 30 or 35 nucleotides in length. However, longer molecules have inventive utility, and are thus within the scope of the present invention.

Preferably, the hybridizing portion of the inventive hybridizing nucleic acids is at least 95%, or at least 98%, or 100% identical to the sequence, or to a portion thereof of SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351, or to the complements thereof.

Hybridizing nucleic acids of the type described herein can be used, for example, as a primer (e.g., a PCR primer), or a diagnostic and/or prognostic probe or primer. Preferably, hybridization of the oligonucleotide probe to a nucleic acid sample is performed under stringent conditions and the probe is 100% identical to the target sequence. Nucleic acid duplex or hybrid stability is expressed as the melting temperature or Tm, which is the temperature at which a probe dissociates from a target DNA. This melting temperature is used to define the required stringency conditions.

For target sequences that are related and substantially identical to the corresponding sequence of SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12 (such as allelic variants and SNPs), rather than identical, it is useful to first establish the lowest temperature at which only homologous hybridization occurs with a particular concentration of salt (e.g., SSC or SSPE). Then, assuming that 1% mismatching results in a 1° C. decrease in the Tm, the temperature of the final wash in the hybridisation reaction is reduced accordingly (for example, if sequences having >95% identity with the probe are sought, the final wash temperature is decreased by 5° C.). In practice, the change in Tm can be between 0.5° C. and 1.5° C. per 1% mismatch.

Examples of inventive oligonucleotides of length X (in nucleotides), as indicated by polynucleotide positions with reference to, e.g., SEQ ID NO:23, include those corresponding to sets (sense and antisense sets) of consecutively overlapping oligonucleotides of length X, where the oligonucleotides within each consecutively overlapping set (corresponding to a given X value) are defined as the finite set of Z oligonucleotides from nucleotide positions:

n to (n+(X−1));
where n=1, 2, 3, ... (Y−(X−1));
where Y equals the length (nucleotides or base pairs) of SEQ ID NO: 23 (9001);
where X equals the common length (in nucleotides) of each oligonucleotide in the set (e.g., X=20 for a set of consecutively overlapping 20-mers); and
where the number (Z) of consecutively overlapping oligomers of length X for a given SEQ ID NO of length Y is equal to Y−(X−1). For example Z=9001−19=8,982 for either sense or antisense sets of SEQ ID NO: 23, where X=20.

Preferably, the set is limited to those oligomers that comprise at least one CpG, TpG or CpA dinucleotide.

Examples of inventive 20-mer oligonucleotides include the following set of oligomers (and the antisense set complementary thereto), indicated by polynucleotide positions with reference to SEQ ID NO: 23: 1-20, 2-21, 3-22, 4-23, 5-24, ... and 8,982-9,001.

Preferably, the set is limited to those oligomers that comprise at least one CpG, TpG or CpA dinucleotide.

Likewise, examples of inventive 25-mer oligonucleotides include the following set of oligomers (and the antisense set complementary thereto), indicated by polynucleotide positions with reference to SEQ ID NO: 23: 1-25, 2-26, 3-27, 4-28, 5-29, ... and 8,977-9,001.

Preferably, the set is limited to those oligomers that comprise at least one CpG, TpG or CpA dinucleotide.

The present invention encompasses, for each of SEQ ID NO: 23, -250-251, 372-373, SEQ ID NO: 1130 to AND SEQ ID NO: 49, SEQ ID NO: 46, SEQ ID NO: 5, SEQ ID NO: 35, SEQ ID NO: 16, SEQ ID NO: 43, SEQ ID NO: 12 (sense and antisense), multiple consecutively overlapping sets of oligonucleotides or modified oligonucleotides of length X, where, e.g., X=9, 10, 17, 20, 22, 23, 25, 27, 30 or 35 nucleotides.

The oligonucleotides or oligomers according to the present invention constitute effective tools useful to ascertain genetic and epigenetic parameters of the genomic sequence corresponding to SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12. Preferred sets of such oligonucleotides or modified oligonucleotides of length X are those consecutively overlapping sets of oligomers corresponding to SEQ ID NO: 23, 250-251, 372-373, SEQ ID NO: 1130 AND SEQ ID NO: 49, SEQ ID NO: 46, SEQ ID NO: 5, SEQ ID NO: 35, SEQ ID NO: 16, SEQ ID NO: 43, SEQ ID NO: 12 (and to the complements thereof). Preferably, said oligomers comprise at least one CpG, TpG or CpA dinucleotide.

Particularly preferred oligonucleotides or oligomers according to the present invention are those in which the cytosine of the CpG dinucleotide (or of the corresponding converted TpG or CpA dinucleotide) sequences is within the middle third of the oligonucleotide; that is, where the oligonucleotide is, for example, 13 bases in length, the CpG, TpG or CpA dinucleotide is positioned within the fifth to ninth nucleotide from the 5'-end.

The oligonucleotides of the invention can also be modified by chemically linking the oligonucleotide to one or more moieties or conjugates to enhance the activity, stability or detection of the oligonucleotide. Such moieties or conjugates include chromophores, fluorophores, lipids such as cholesterol, cholic acid, thioether, aliphatic chains, phospholipids, polyamines, polyethylene glycol (PEG), palmityl moieties, and others as disclosed in, for example, U.S. Pat. Nos. 5,514,758, 5,574,142, 5,585,481, 5,587,371, 5,597,696 and 5,958,773. The probes may also exist in the form of a PNA (peptide nucleic acid) which has particularly preferred pairing properties. Thus, the oligonucleotide may include other appended groups such as peptides, and may include hybridization-triggered cleavage agents (Krol et al., BioTechniques 6:958-976, 1988) or intercalating agents (Zon, Pharm. Res. 5:539-549, 1988). To this end, the oligonucleotide may be conjugated to another molecule, e.g., a chromophore, fluorophor, peptide, hybridization-triggered cross-linking agent, transport agent, hybridisation-triggered cleavage agent, etc.

The oligonucleotide may also comprise at least one art-recognized modified sugar and/or base moiety, or may comprise a modified backbone or non-natural internucleoside linkage.

The oligonucleotides or oligomers according to particular embodiments of the present invention are typically used in 'sets,' which contain at least one oligomer for analysis of each of the CpG dinucleotides of genomic sequences SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12 and sequences complementary thereto, or to the corresponding CpG, TpG or CpA dinucleotide within a sequence of the treated nucleic acids according to SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351 and sequences complementary thereto. However, it is anticipated that for economic or other factors it may be preferable to analyze a limited selection of the CpG dinucleotides within said sequences, and the content of the set of oligonucleotides is altered accordingly.

Therefore, in particular embodiments, the present invention provides a set of at least two (2) (oligonucleotides and/or PNA-oligomers) useful for detecting the cytosine methylation state of treated genomic DNA (SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351), or in genomic DNA (SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12 and sequences complementary thereto). These probes enable diagnosis, and/or classification of genetic and epigenetic parameters of lung cell proliferative disorders. The set of oligomers may also be used for detecting single nucleotide polymorphisms (SNPs) in treated genomic DNA (SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351), or in genomic DNA (SEQ ID NO: 23, SEQ ID NO: 1130, SEQ ID NO: 1131 AND SEQ ID NO: 49, SEQ ID NO: 46, SEQ ID NO: 5, SEQ ID NO: 35, SEQ ID NO: 16, SEQ ID NO: 43, SEQ ID NO: 12 and sequences complementary thereto).

In preferred embodiments, at least one, and more preferably all members of a set of oligonucleotides is bound to a solid phase.

In further embodiments, the present invention provides a set of at least two (2) oligonucleotides that are used as 'primer' oligonucleotides for amplifying DNA sequences of one of SEQ ID NO: 250-251, 372-373, SEQ ID NO: 1132 to SEQ ID NO: 1139 AND SEQ ID Nos: 302-303, 296-297, 214-215, 274-275, 236-237, 290-291, 228-229, 250-251, 424-425, 418-419, 336-337, 396-397, 358-359, 412-413, 350-351 and sequences complementary thereto, or segments thereof.

It is anticipated that the oligonucleotides may constitute all or part of an "array" or "DNA chip" (i.e., an arrangement of different oligonucleotides and/or PNA-oligomers bound to a solid phase). Such an array of different oligonucleotide- and/or PNA-oligomer sequences can be characterized, for example, in that it is arranged on the solid phase in the form of a rectangular or hexagonal lattice. The solid-phase surface may be composed of silicon, glass, polystyrene, aluminium, steel, iron, copper, nickel, silver, or gold. Nitrocellulose as well as plastics such as nylon, which can exist in the form of pellets or also as resin matrices, may also be used. An overview of the prior art in oligomer array manufacturing can be gathered from a special edition of Nature Genetics (Nature Genetics Supplement, Volume 21, January 1999, and from the literature cited therein). Fluorescently labeled probes are often used for the scanning of immobilized DNA arrays. The simple attachment of Cy3 and Cy5 dyes to the 5'-OH of the specific probe are particularly suitable for fluorescence labels. The detection of the fluorescence of the hybridized probes may be carried out, for example, via a confocal microscope. Cy3 and Cy5 dyes, besides many others, are commercially available.

It is also anticipated that the oligonucleotides, or particular sequences thereof, may constitute all or part of an "virtual array" wherein the oligonucleotides, or particular sequences thereof, are used, for example, as 'specifiers' as part of, or in combination with a diverse population of unique labeled probes to analyze a complex mixture of analytes. Such a method, for example is described in US 2003/0013091 (U.S.

Ser. No. 09/898,743, published 16 Jan. 2003). In such methods, enough labels are generated so that each nucleic acid in the complex mixture (i.e., each analyte) can be uniquely bound by a unique label and thus detected (each label is directly counted, resulting in a digital read-out of each molecular species in the mixture).

The described invention further provides a composition of matter useful for providing a prognosis and/or prediction of outcome of endocrine treatment of breast cancer patients. Said composition comprising at least one nucleic acid 18 base pairs in length of a segment of the nucleic acid sequence disclosed in SEQ ID NO: 250-251, 372-373, 1132, 1133, 1136 and 1137, and one or more substances taken from the group comprising: magnesium chloride, dNTP, taq polymerase, bovine serum albumen, an oligomer in particular an oligonucleotide or peptide nucleic acid (PNA)-oligomer, said oligomer comprising in each case at least one base sequence having a length of at least 9 nucleotides which is complementary to, or hybridizes under moderately stringent or stringent conditions to a pretreated genomic DNA according to one of the SEQ ID NO: 250-251, 372-373 and SEQ ID NO: 1132, 1133, 1136 and 1137 and sequences complementary thereto. It is preferred that said composition of matter comprises a buffer solution appropriate for the stabilization of said nucleic acid in an aqueous solution and enabling polymerase based reactions within said solution. Suitable buffers are known in the art and commercially available.

Moreover, an additional aspect of the present invention is a kit comprising, for example: a bisulfite-containing reagent as well as at least one oligonucleotide whose sequences in each case correspond, are complementary, or hybridize under stringent or highly stringent conditions to a 18-base long segment of the sequences SEQ ID NO: 250-251, 372-373, 1132, 1133, 1136 and 1137. Said kit may further comprise at least one oligonucleotide whose sequences in each case correspond, are complementary, or hybridize under stringent or highly stringent conditions to a 18-base long segment of the sequences SEQ ID Nos: 302-303, 296-297, 214-215, 274-275, 236-237, 290-291, 228-229, 250-251, 424-425, 418-419, 336-337, 396-397, 358-359, 412-413, 350-351. Said kit may further comprise instructions for carrying out and evaluating the described method. In a further preferred embodiment, said kit may further comprise standard reagents for performing a CpG position-specific methylation analysis, wherein said analysis comprises one or more of the following techniques: MS-SNuPE, MSP, MethyLight®, HeavyMethyl®, COBRA, and nucleic acid sequencing. However, a kit along the lines of the present invention can also contain only part of the aforementioned components.

Typical reagents (e.g., as might be found in a typical COBRA-based kit) for COBRA analysis may include, but are not limited to: PCR primers for specific gene (or methylation-altered DNA sequence or CpG island); restriction enzyme and appropriate buffer; gene-hybridization oligo; control hybridization oligo; kinase labeling kit for oligonucleotide probe; and radioactive nucleotides. Additionally, bisulfite conversion reagents may include: DNA denaturation buffer; sulfonation buffer; DNA recovery reagents or kits (e.g., precipitation, ultrafiltration, affinity column); desulfonation buffer; and DNA recovery components.

Typical reagents (e.g., as might be found in a typical MethyLight®-based kit) for MethyLight® analysis may include, but are not limited to: PCR primers for specific gene (or methylation-altered DNA sequence or CpG island); TaqMan® probes; optimized PCR buffers and deoxynucleotides; and Taq polymerase.

Typical reagents (e.g., as might be found in a typical Ms-SNuPE-based kit) for Ms-SNuPE analysis may include, but are not limited to: PCR primers for specific gene (or methylation-altered DNA sequence or CpG island); optimized PCR buffers and deoxynucleotides; gel extraction kit; positive control primers; Ms-SNuPE primers for specific gene; reaction buffer (for the Ms-SNuPE reaction); and radioactive nucleotides. Additionally, bisulfite conversion reagents may include: DNA denaturation buffer; sulfonation buffer; DNA recovery regents or kit (e.g., precipitation, ultrafiltration, affinity column); desulfonation buffer; and DNA recovery components.

Typical reagents (e.g., as might be found in a typical MSP-based kit) for MSP analysis may include, but are not limited to: methylated and unmethylated PCR primers for specific gene (or methylation-altered DNA sequence or CpG island), optimized PCR buffers and deoxynucleotides, and specific probes.

While the present invention has been described with specificity in accordance with certain of its preferred embodiments, the following examples and figures serve only to illustrate the invention and is not intended to limit the invention within the principles and scope of the broadest interpretations and equivalent configurations thereof.

While the present invention has been described with specificity in accordance with certain of its preferred embodiments, the following examples and figures serve only to illustrate the invention and is not intended to limit the invention within the principles and scope of the broadest interpretations and equivalent configurations thereof.

BRIEF DESCRIPTION OF THE DRAWINGS

FIG. 99 shows the distribution of follow-up times in ER+, N0, untreated population according to Example 2. Frequency is shown on the Y-axis and time in months is shown on the X-axis. The figure on the left shows patients with event (all kinds of relapses). Mean follow-up time 45.8 months (standard deviation=31), median=38 (range=[2, 123]).

The figure on the right shows censored patients. Mean follow up time 93 months (standard deviation=35.6), median=94 (range=[1, 190]).

Figure 100:
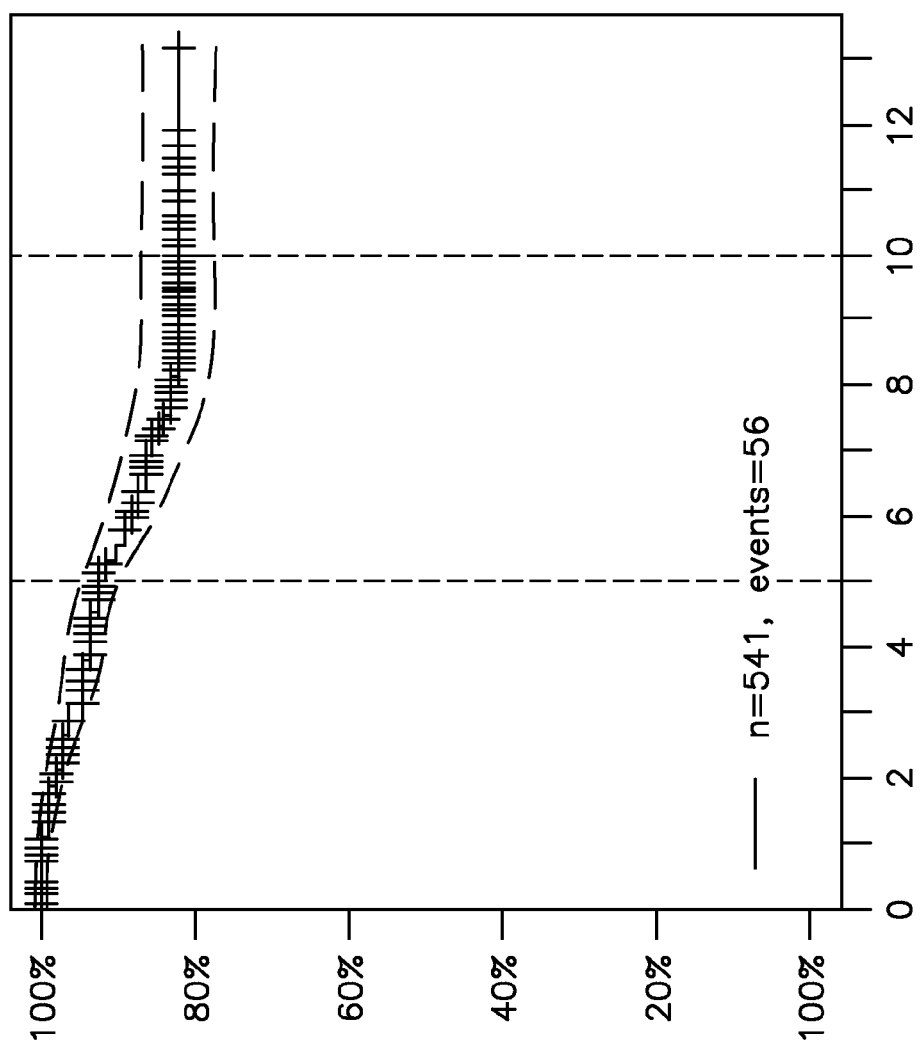

FIG. 100 shows the Disease free survival (DFS) of ER+, N0, TAM treated population in Kaplan-Meier plot according to Example 2. Proportion of disease free patients is shown on the Y-axis and time in years is shown on the X-axis. 56 events were observed (observed event rate=10%). DFS after 5 years: 92.4% [90%, 94.9%], after 10 years: 82.1% [77.3%, 87.2%]. 95% confidence intervals are plotted.

Figure 101:
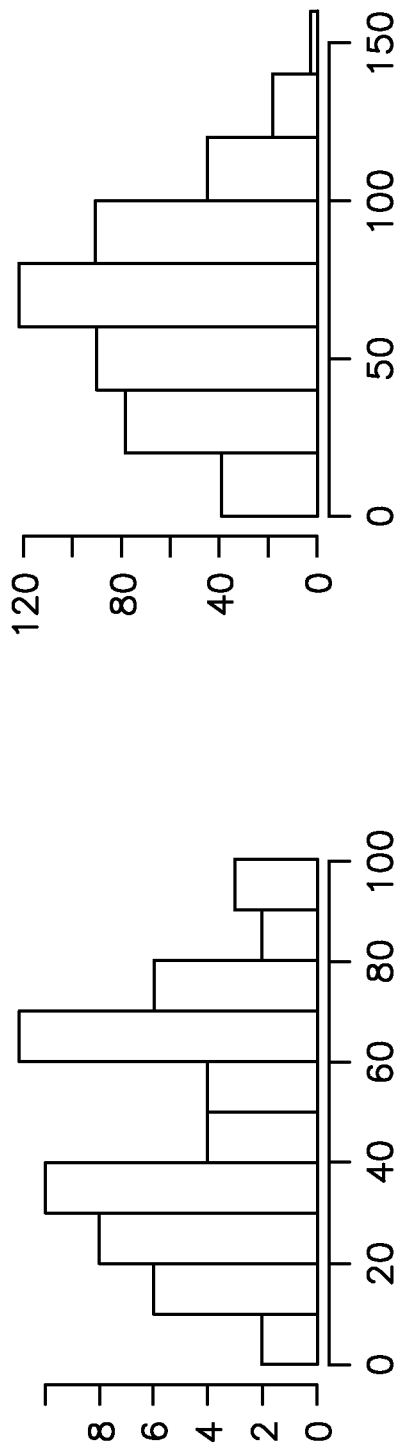
Figure 102A:
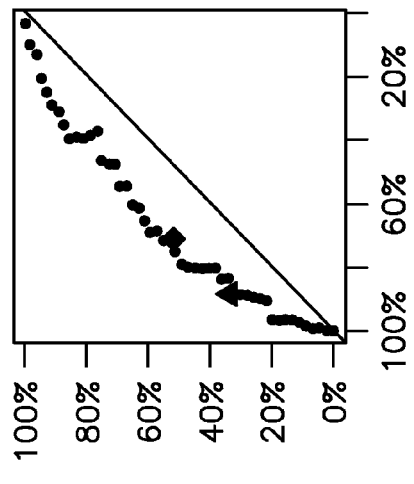
Figure 102B:
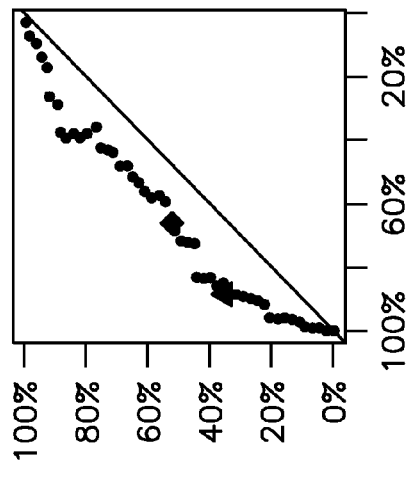
Figure 102C:
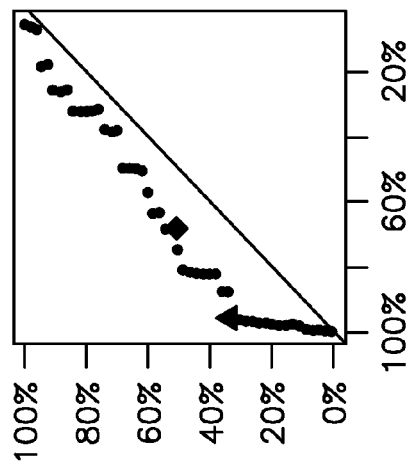
Figure 102D:
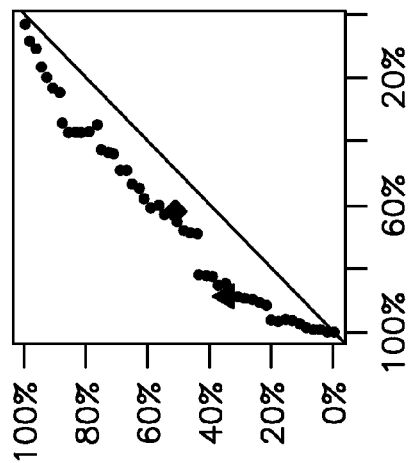
Figure 103A:
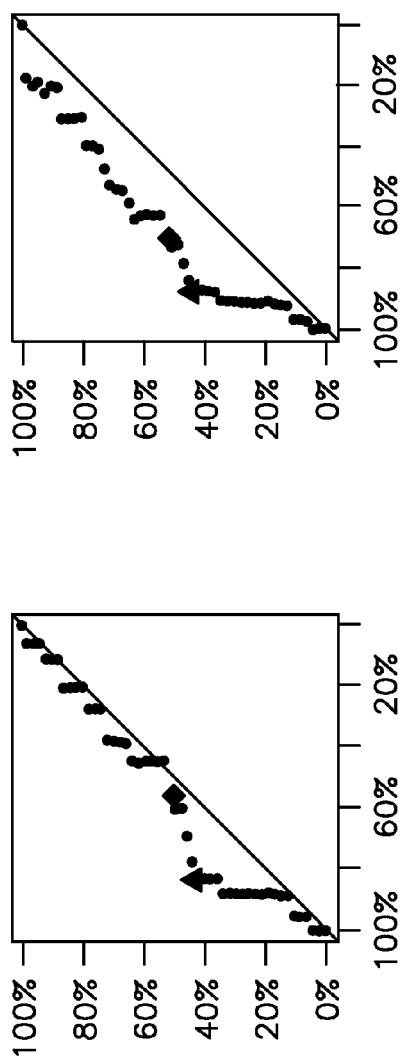
Figure 103B:
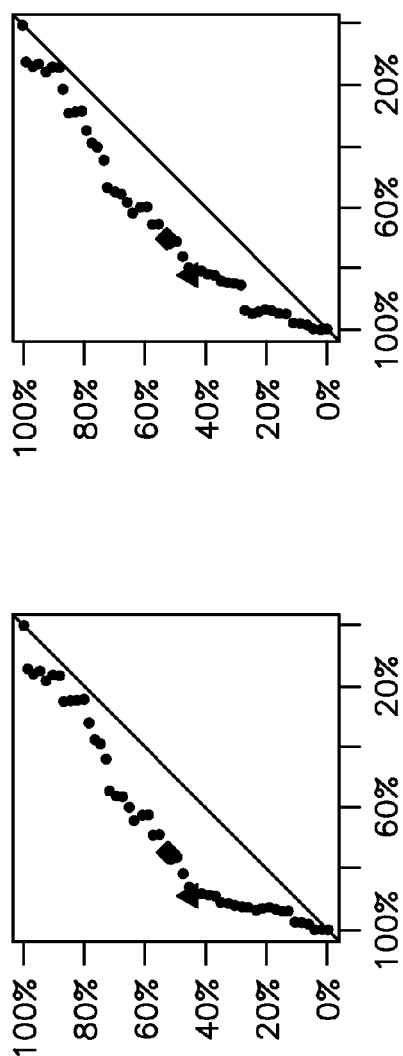
Figure 103C:
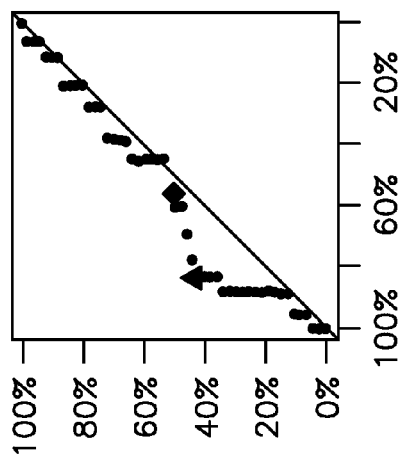
Figure 103D:
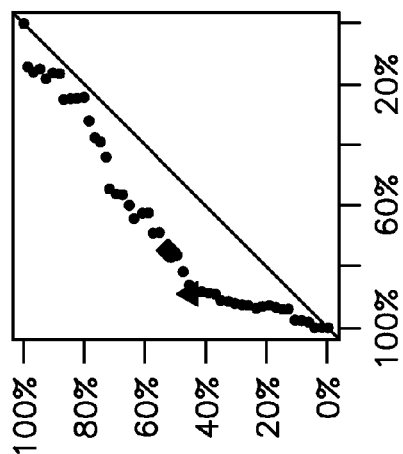
Figure 104A:
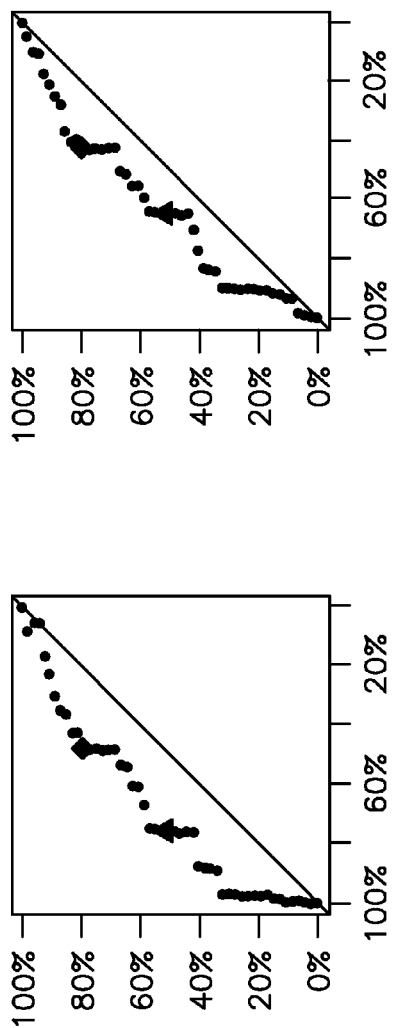
Figure 104B:
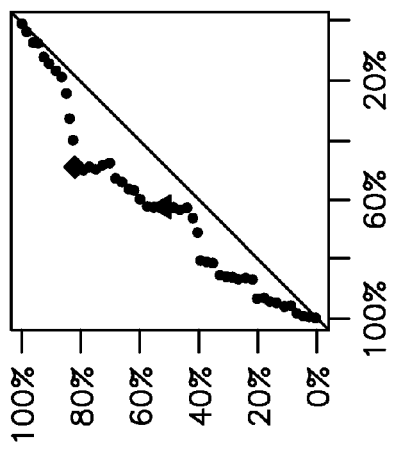
Figure 104C:
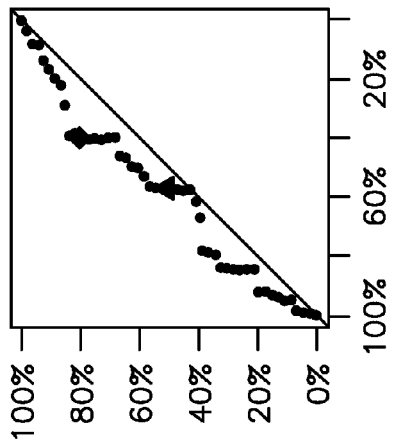
Figure 104D:
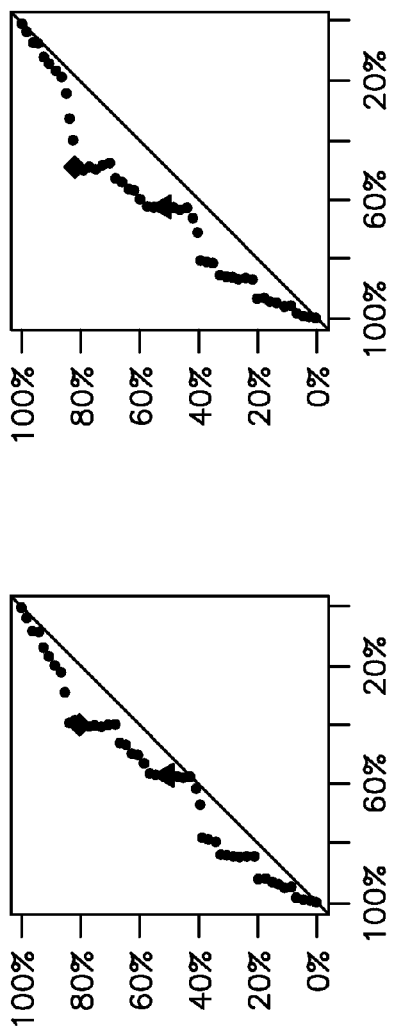

FIG. 101 shows the distribution of follow-up times in ER+, N0, untreated population according to Example 2. Frequency is shown on the Y-axis and time in months is shown on the X-axis. The figure on the left shows patients with all events (all kinds of relapses). Mean follow-up time 47.9 months (standard deviation=24.4), median=45 (range=[2, 98]).

The figure on the right shows censored patients. Mean follow up time 65.3 months (standard deviation=31.6), median=64 (range=[0, 158]).

FIG. 102 shows the ROC plot at different times for marker model 3522 (Assay 1) and 2265 on ER+N0 TAM treated population according to Example 2. Figure A shows the plot at 60 months, FIG. B shows the plot at 72 months, FIG. C shows the plot at 84 months and FIG. D shows the plot at 96 months. Only distant metastasis are defined as events. Sensitivity (proportion of all relapsed patients in poor prognostic group) shown on the X-axis and specificity (proportion of all relapse free patients in good prognostic group) shown on the Y-axis are calculated from KM estimates, and the estimated area under the curve (AUC) is calculated. Values for median cut off (triangle) and best cut off (diamond, 0.32 quantile) are plotted.

FIG. 103 shows the ROC plot at different times for marker model 3522 (Assay 1) alone on ER+N0 TAM treated population according to Example 2. FIG. A shows the plot at 60 months, FIG. B shows the plot at 72 months, FIG. C shows the plot at 84 months and FIG. D shows the plot at 96 months. Only distant metastasis are defined as events. Sensitivity (proportion of all relapsed patients in poor prognostic group) shown on the X-axis and specificity (proportion of all relapse free patients in good prognostic group) shown on the Y-axis are calculated from KM estimates, and the estimated area under the curve (AUC) is calculated. Values for median cut off (triangle) and best cut off (diamond, 0.42 quantile) are plotted.

FIG. 104 shows the ROC plot at different times for marker model 2265 on ER+N0 TAM treated population according to Example 2. FIG. A shows the plot at 60 months, FIG. B shows the plot at 72 months, FIG. C shows the plot at 84 months and FIG. D shows the plot at 96 months. Only distant metastasis are defined as events. Sensitivity (proportion of all relapsed patients in poor prognostic group) shown on the X-axis and specificity (proportion of all relapse free patients in good prognostic group) shown on the Y-axis are calculated from KM estimates for different thresholds (=5, 6, 7, 8 years) and the estimated area under the curve (AUC) is calculated. Values for median cut off (triangle) and best cut off (diamond, 0.78 quantile) are plotted.

FIG. 105 shows the ROC plot at different times for marker model 2395 on ER+N0 TAM treated population according to Example 2. FIG. A shows the plot at 60 months, FIG. B shows the plot at 72 months, FIG. C shows the plot at 84 months and FIG. D shows the plot at 96 months. Only distant metastasis are defined as events. Sensitivity (proportion of all relapsed patients in poor prognostic group) shown on the X-axis and specificity (proportion of all relapse free patients in good prognostic group) shown on the Y-axis are calculated from KM estimates for different thresholds (=5, 6, 7, 8 years), and the estimated area under the curve (AUC) is calculated. Values for median cut off (triangle) and best cut off (diamond, 0.77 quantile) are plotted.

FIG. 106 illustrates the robustness of marker models by a crossvalidation performed on model marker panel PITX2 (Assay 1) plus TFF1 and marker panel PITX2 (Assay 1) alone, with 200 replicates. The stability of the assignment of one certain patient to the bad or good outcome group is shown. The left hand figure shows model marker panel PITX2 (Assay 1) plus TFF1 and the right hand figure shows model marker panel PITX2 (Assay 1) alone. The plot illustrates in how many crossvalidation replicates each patient gets assigned to group 1 (light grey) or group 2 (dark grey).

FIG. 107 illustrates the amino acid sequence of the polypeptide encoded by the gene PITX2.

FIG. 108 illustrates the positions of the amplificates sequenced in Example 3. 'A' shows an illustration of the gene with the major exons annotated, 'B' shows annotated mRNA transcript variants and 'C' shows CpG rich regions of the gene. The positions of Amplificates 1 to 11 are shown to the right of the illustrations.

Figure 109:
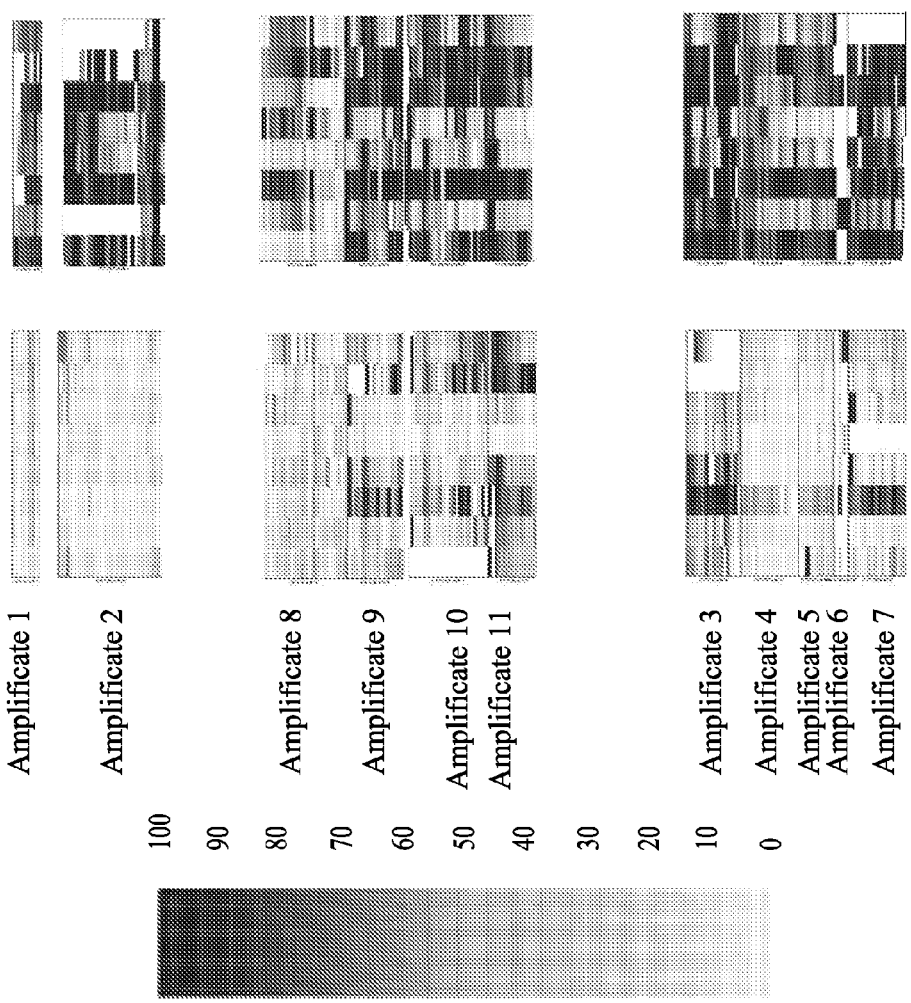

FIG. 109 shows the sequencing data of 11 amplificates of the gene PITX2 according to Example 3. Each column of the matrices of columns 'A' and 'B' represent the sequencing data for one amplificate. The amplificate number is shown to the left of the matrices. Each row of a matrix represents a single CpG site within the fragment and each column represents an individual DNA sample. The matrices in the column marked 'A' showed below median methylation as measured by QM assays, the matrices in the column marked 'B' showed below median methylation as measured by QM assays. The bar on the left represents a scale of the percent methylation, with the degree of methylation represented by the shade of each position within the column from black representing 100% methylation to light grey representing 0% methylation. White positions represented a measurement for which no data was available.

Figure 110:
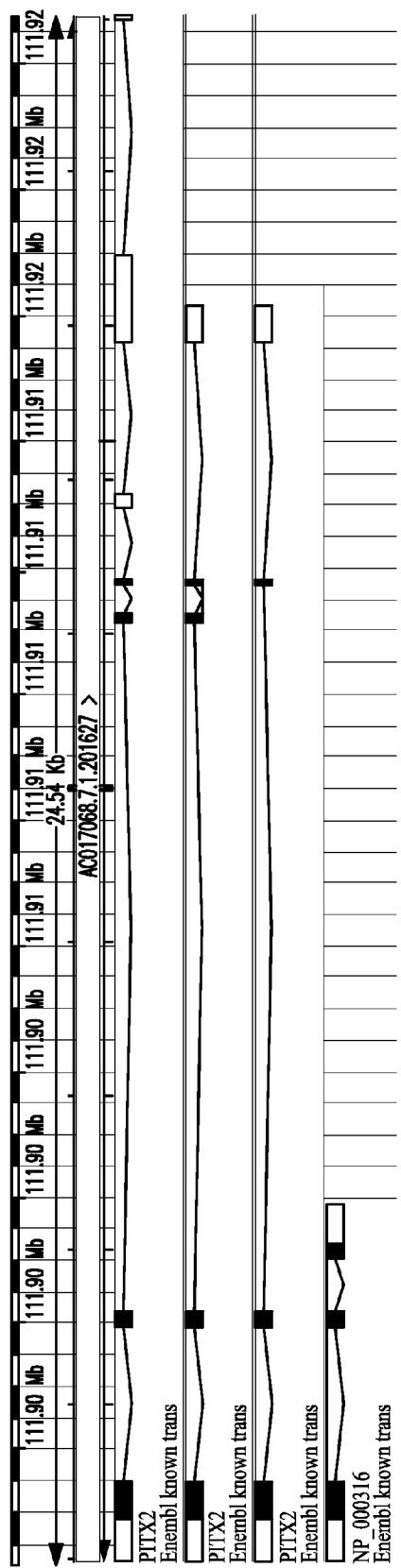

FIG. 110 shows a schematic view of mRNA transcript variants of PITX2, as annotated in the on-line Ensembl database.

SEQ ID NOS: 1 to 61 and 149 to 150 represent 5' and/or regulatory regions and/or CpG rich regions of the genes according to Table 1. These sequences are derived from Genbank and will be taken to include all minor variations of the sequence material which are currently unforeseen, for example, but not limited to, minor deletions and SNPs.

EXAMPLE 1

DNA samples were extracted using the Wizzard Kit (Promega), samples from 278 patients were analysed, data analyses were carried out on a selection of candidate markers.

Bisulfite Treatment and mPCR

Total genomic DNA of all samples was bisulfite treated converting unmethylated cytosines to uracil. Methylated cytosines remained conserved. Bisulfite treatment was performed with minor modifications according to the protocol described in Olek et al. (1996). After bisulfitation 10 ng of each DNA sample was used in subsequent mPCR reactions containing 6-8 primer pairs.

Each reaction contained the following:
2.5 pmol each primer
11.25 ng DNA (bisulfite treated)
Multiplex PCR Master mix (Qiagen)

Further details of the primers are shown in TABLE 2.

Initial denaturation was carried out at 95° C. for 15 min. Forty cycles were carried out as follows: Denaturation at 95° C. for 30 sec, followed by annealing at 57° C. for 90 sec., primer elongation at 72° C. for 90 sec. A final elongation at 72° C. was carried out for 10 min.

Hybridisation

All PCR products from each individual sample were then hybridised to glass slides carrying a pair of immobilised oligonucleotides for each CpG position under analysis. Each of these detection oligonucleotides was designed to hybridise to the bisulphite converted sequence around one CpG site which was either originally unmethylated (TG) or methylated (CG). See Table 2 for further details of hybridisation oligonucleotides used. Hybridisation conditions were selected to allow the detection of the single nucleotide differences between the TG and CG variants.

5 µl volume of each multiplex PCR product was diluted in 10× Ssarc buffer. The reaction mixture was then hybridised to the detection oligonucleotides as follows. Denaturation at 95° C., cooling down to 10° C., hybridisation at 42° C. overnight followed by washing with 10× Ssarc and dH2O at 42° C. Further details of the hybridisation oligonucleotides are shown in TABLE 3.

Fluorescent signals from each hybridised oligonucleotide were detected using genepix scanner and software. Ratios for the two signals (from the CG oligonucleotide and the TG oligonucleotide used to analyse each CpG position) were calculated based on comparison of intensity of the fluorescent signals.

Data Analysis Methods

Analysis of the chip data: From raw hybridisation intensities to methylation ratios; The log methylation ratio (log(CG/TG)) at each CpG position is determined according to a standardised preprocessing pipeline that includes the following steps: For each spot the median background pixel intensity is subtracted from the median foreground pixel intensity (this gives a good estimate of background corrected hybridisation intensities): For both CG and TG detection oligonucleotides of each CpG position the background corrected median of the 4 redundant spot intensities is taken; For each chip and each CpG position the log(CG/TG) ratio is calculated; For each sample the median of log(CG/TG) intensities over the redundant chip repetitions is taken. This ratio has the property that the hybridisation noise has approximately constant variance over the full range of possible methylation rates (Huber et al., 2002).

Hypothesis Testing

The main task is to identify markers that show significant differences in the average degree of methylation between two classes. A significant difference is detected when the nullhypothesis that the average methylation of the two classes is identical can be rejected with p<0.05. Because we apply this test to a whole set of potential markers we have to correct the p-values for multiple testing. This was done by applying the False Discovery Rate (FDR) method (Dudoit et al., 2002).

For testing the null hypothesis that the methylation levels in the two classes are identical we used the likelihood ratio test for logistic regression models (Venables and Ripley, 2002). The logistic regression model for a single marker is a linear combination of methylation measurements from all CpG positions in the respective genomic region of interest (ROI). A significant p-value for a marker means that this ROI has some systematic correlation to the question of interest as given by the two classes. However, at least formally it makes no statement about the actual predictive power of the marker.

Logistic Regression

Logistic regression models are tools to model the probability of an event in dependence of one or more variables or factors. For example, if x denotes a specific methylation log ratio, the probability that a patient responds to the applied therapy (Tamoxifen) is modeled as $$P(response|x)=\exp(\alpha+\beta x)/[1+\exp(\alpha+\beta x)]. \quad (1)$$

If $x_1, \ldots, x_k$ denote the k methylation log ratios measured for one amplificate, the model is $$P(response|x_1, \ldots, x_k)=\exp(\alpha+\beta_1 x_1+ \ldots +\beta_k x_k)/[1+\exp(\alpha+\beta_1 x_1+ \ldots +\beta_k x_k)]. \quad (2)$$

Significance of the respective amplificate is assessed using a likelihood-ratio test. This test calculates the difference of −2 Log(likelihood) for the full model and the null-model including just the intercept $\alpha$ which is approximately $\chi^2$-distributed with k degrees of freedom under the null hypotheses $\beta_1= \ldots =\beta_k=0$.

If additional covariates are considered, the model contains an additional parameter for each covariate and the test statistic is calculated as the difference of −2 Log(likelihood) or the full model and the null-model including intercept and covariates. Again, given the null hypothesis, this difference is approximately $\chi^2$-distributed with k degrees of freedom.

Ranked Matrices

For a graphical display of all group comparisons, ranked matrices are used. Each row represents one oligo pair, whereas each column of the matrix stands for one sample (or chip in the case of up-versus downmethylated Promega DNA comparisons). Oligo pairs are ranked according to their discriminatory power (Wilcoxon test, Fisher score or logistic regression), where the best "marker" is displayed on the bottom line. Low methylation is displayed in light grey, high methylation in dark grey, and the data are normalized prior to display.

Cox Regression

Disease-free survival times (DFS) are modeled using Cox regression models. These models are similar to logistic regression models, but instead of probabilities, the hazard is modeled. The hazard gives the instantaneous risk of a relapse. The models $$h(t|x)=h_0(t)\cdot\exp(\beta x) \quad (3)$$

and $$h(t|x_1, \ldots, x_k)=h_0(t)\cdot\exp(\beta_1 x_1+ \ldots +\beta_k x_k) \quad (4)$$

are used for uni- and multivariate analyses, respectively, where t is the time measured in months after surgery and h0(t) is the baseline hazard. Likelihood ratio tests are performed similar to those used for logistic regression. Again, the difference between −2 Log(Likelihood) of full model and null-model is approximately $\chi^2$-distributed with k degrees of freedom under the null hypotheses $\beta 1= \ldots =\beta k=0$. Additional covariates can be included into the models.

Stepwise Regression Analysis

For both multivariate logistic and Cox regression models, a stepwise procedure is used in order to find submodels including only relevant variables. Two effects are usually achieved by these procedures: Variables (methylation ratios) that are basically unrelated to the dependent variable (response state or DFS, respectively) are excluded as they do not add relevant information to the model. Out of a set of highly correlated variables, only the one with the best relation to the dependent variable is retained. Inclusion of both types of variables can lead to numerical instabilities and a loss of power. Moreover, the predictory performance can be low due to overfitting. The applied algorithm aims at minimizing the Akaike information criterion (AIC) which is defined as $$AIC=-2\cdot\text{maximized log-likelihood}+2\cdot\text{\#parameters}.$$

The AIC is related to the predictory performance of a model, smaller values promise better performance. Whereas the inclusion of additional variables always improves the model fit and thus increases the likelihood, the second term penalizes the estimation of additional parameters. The best model will present a compromise model with good fit and usually a small or moderate number of variables.

Results

Adjuvant Setting

Figure 1:
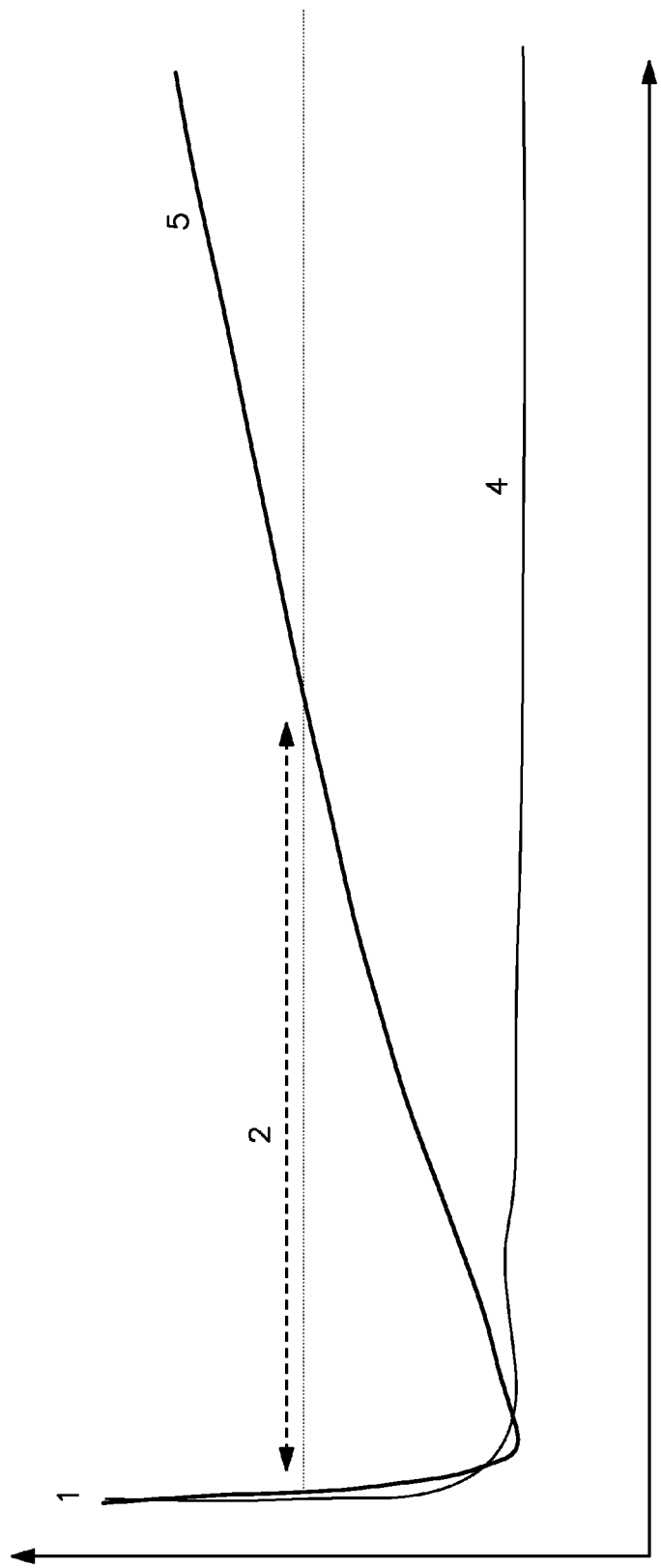
FIG. 1 shows a preferred application of the method according to the invention. The X axis shows the tumour(s) mass, wherein the line '3' shows the limit of detectability. The Y-axis shows time. Accordingly said figure illustrates a simplified model of endocrine treatment of an Stage 1-3 breast tumour wherein primary treatment was surgery (at point 1), followed by adjuvant therapy with Tamoxifen. In a first scenario a responder to treatment (4) is shown as remaining below the limit of detectability for the duration of the observation. A non responder to the treatment (5) has a period of disease free survival (2) followed by relapse when the carcinoma mass reaches the level of detectability.

Analysis of the methylation patterns of patient samples treated with Tamoxifen as an adjuvant therapy immediately following surgery (see FIG. 1) is shown in the plots according to FIGS. 3 to 45. For each amplificate, the mean methylation over all oligo-pairs for that amplificate was calculated and the population split into groups according to their mean methylation values, wherein one group was composed of individuals with a methylation score higher than the median and a second group composed of individuals with a methylation score lower than the median.

The results are shown in FIGS. 3 to 9, as Cox model estimated disease-free survival curves. FIGS. 10 to 34 show the disease free survival curves using the methylation analyses of only single oligonucleotide.

In a further analysis the recurrence of distant metastases only was analysed in FIGS. 35 to 46.

Figure 53:
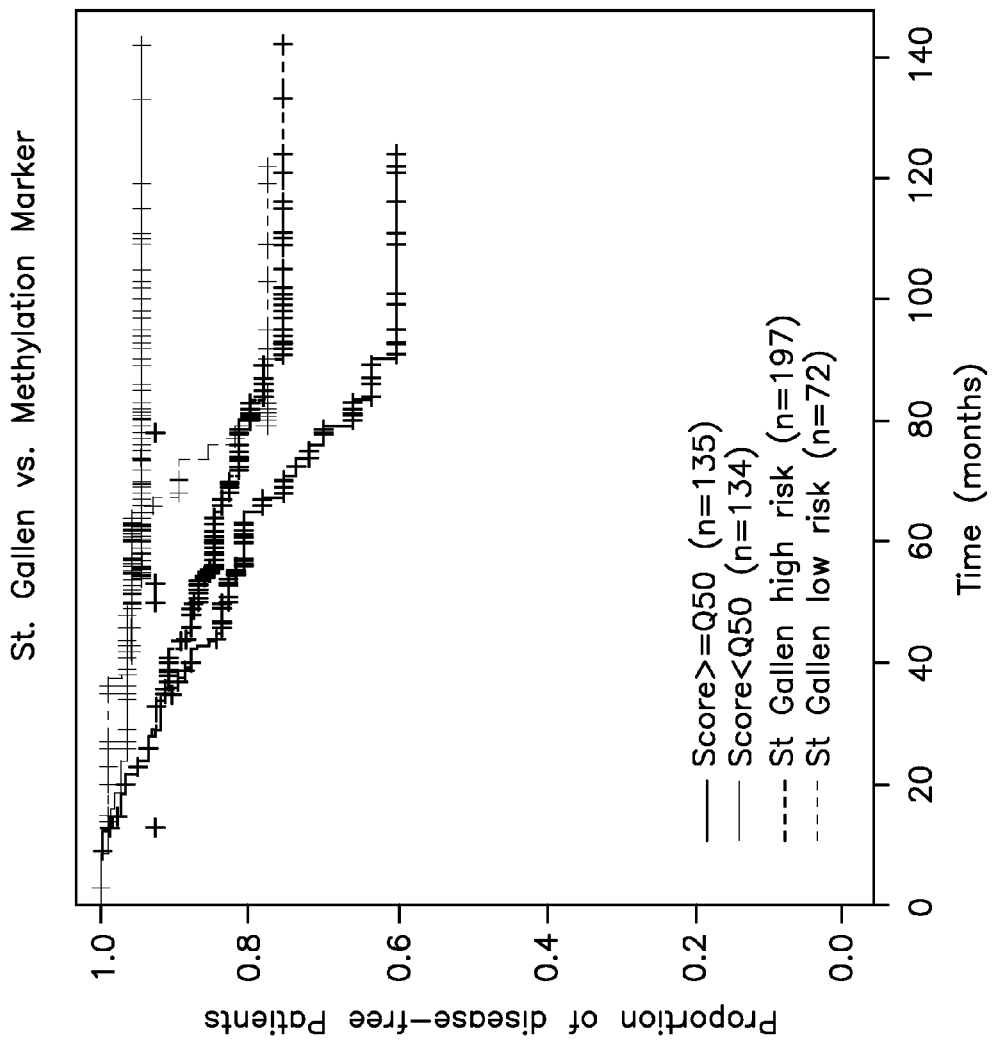
FIG. 53 shows the plot according to FIG. 52 and the classification of the sample set by means of the St. Gallen method. The unbroken lines represent the methylation analysis wherein the black plot shows the proportion of disease free patients in the population with above median methylation levels, the grey plot shows the proportion of disease free patients in the population with below median methylation levels. The broken lines represent the St. Gallen classification of the sample set wherein the black plot shows the disease free survival time of the high risk group and the grey plot shows the disease free survival of the low risk group.

The accuracy of the differentiation between the different groups was further increased by combining multiple oligonucleotides from different genes. FIG. 53 shows the combination of two oligonucleotides each from the genes TBC1D3 and CDK6, and one oligonucleotide from the gene PITX2. the broken lines show the classification of the patients from the sample set by means of the St. Gallen method (the current method of choice for estimating disease free survival) as compared to methylation analysis (unbroken lines), thereby showing the improved effectiveness of methylation analysis over current methods, in particular post 80 months. The St. Gallen method is the most commonly used treatment selection criteria for breast cancer patients. The criteria are revised every two years, and are based upon clinical factors (age, type of cancer, size, metastasis etc.), it is used to divide patients into high risk and low risk cases which follow different rules for therapy.

Metastatic Setting

Figure 2:
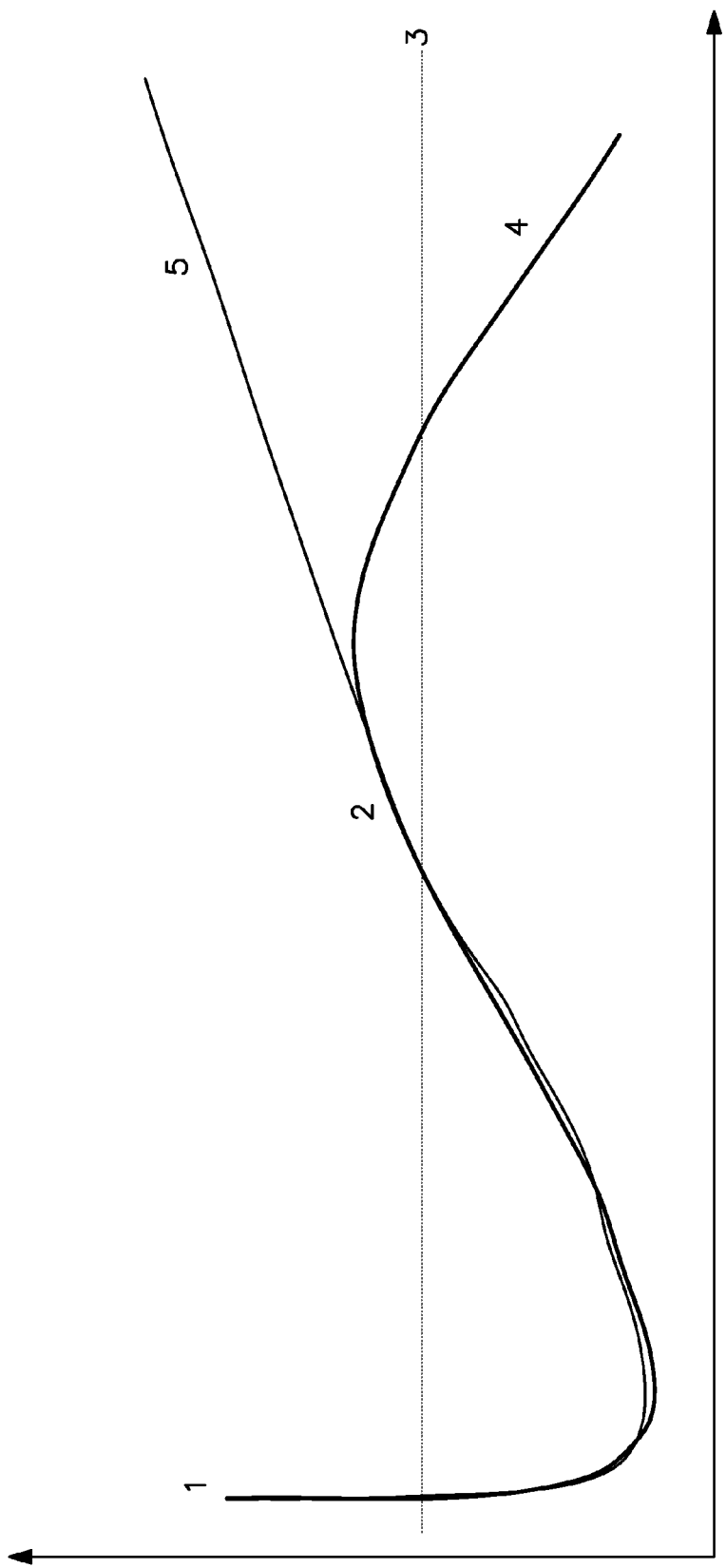
FIG. 2 shows another preferred application of the method according to the invention. The X axis shows the tumour(s) mass, wherein the line '3' shows the limit of detectability. The Y-axis shows time. Accordingly said figure illustrates a simplified model of Endocrine treatment of an late stage breast tumour wherein primary treatment was surgery (at point 1), followed by relapse which is treated by Tamoxifen (2). In a first scenario a responder to treatment (4) is shown as remaining below the limit of detectability for the duration of the observation. A non responder to the treatment (5) does not recover from the relapse.
Figure 3:
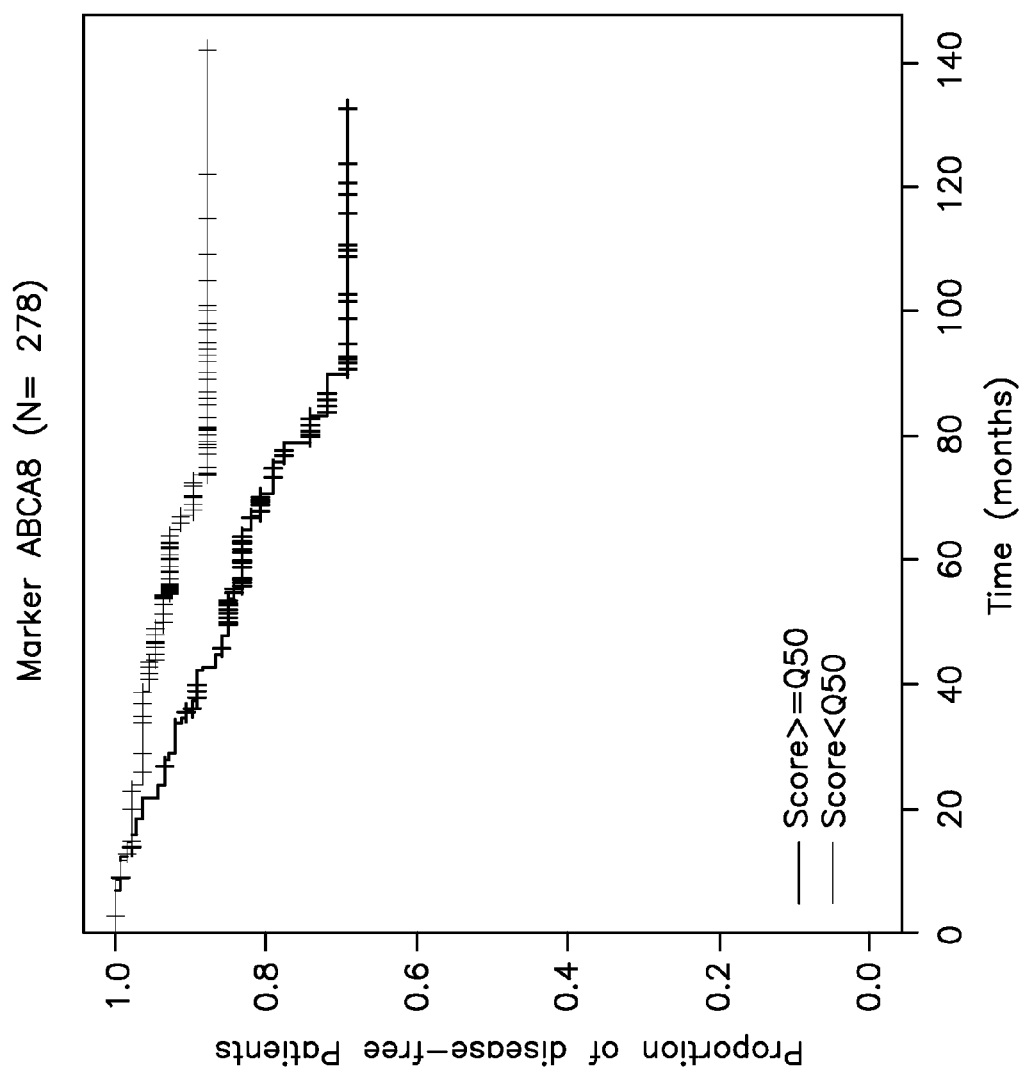
FIGS. 3 to 45 show the Kaplan-Meier estimated disease-free survival curves for single genes or oligonucleotide positions. The black plot shows the proportion of disease free patients in the population with above median methylation levels, the grey plot shows the proportion of disease free patients in the population with below median methylation levels
Figure 4:
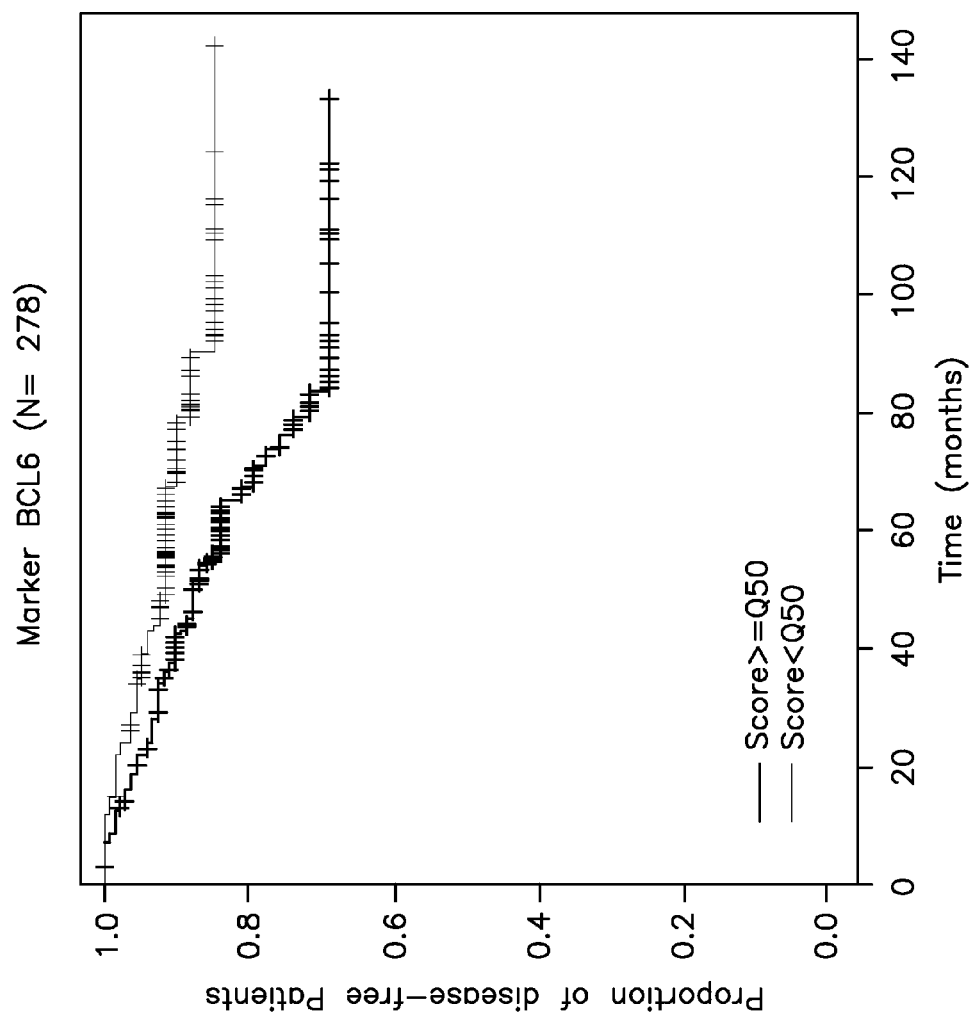
Figure 5:
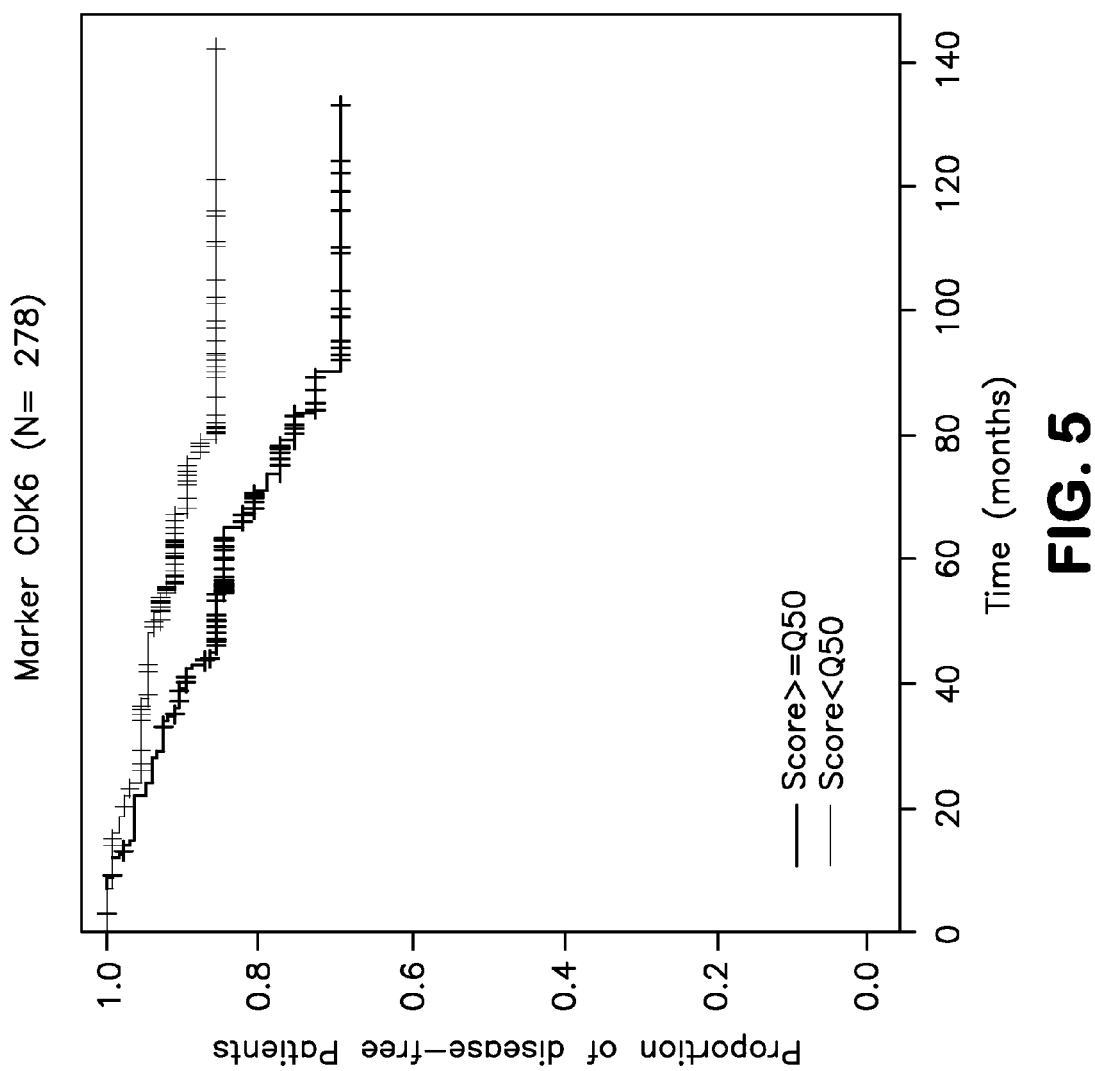
Figure 6:
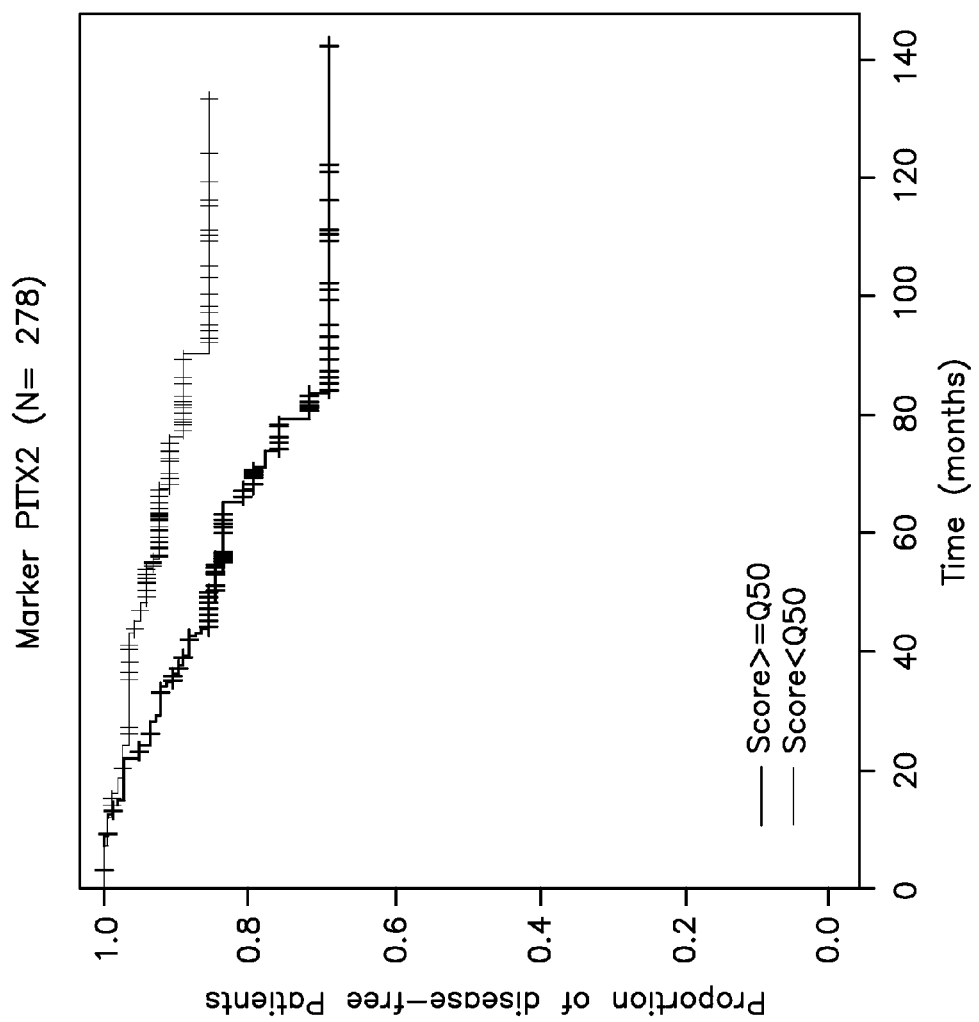
Figure 7:
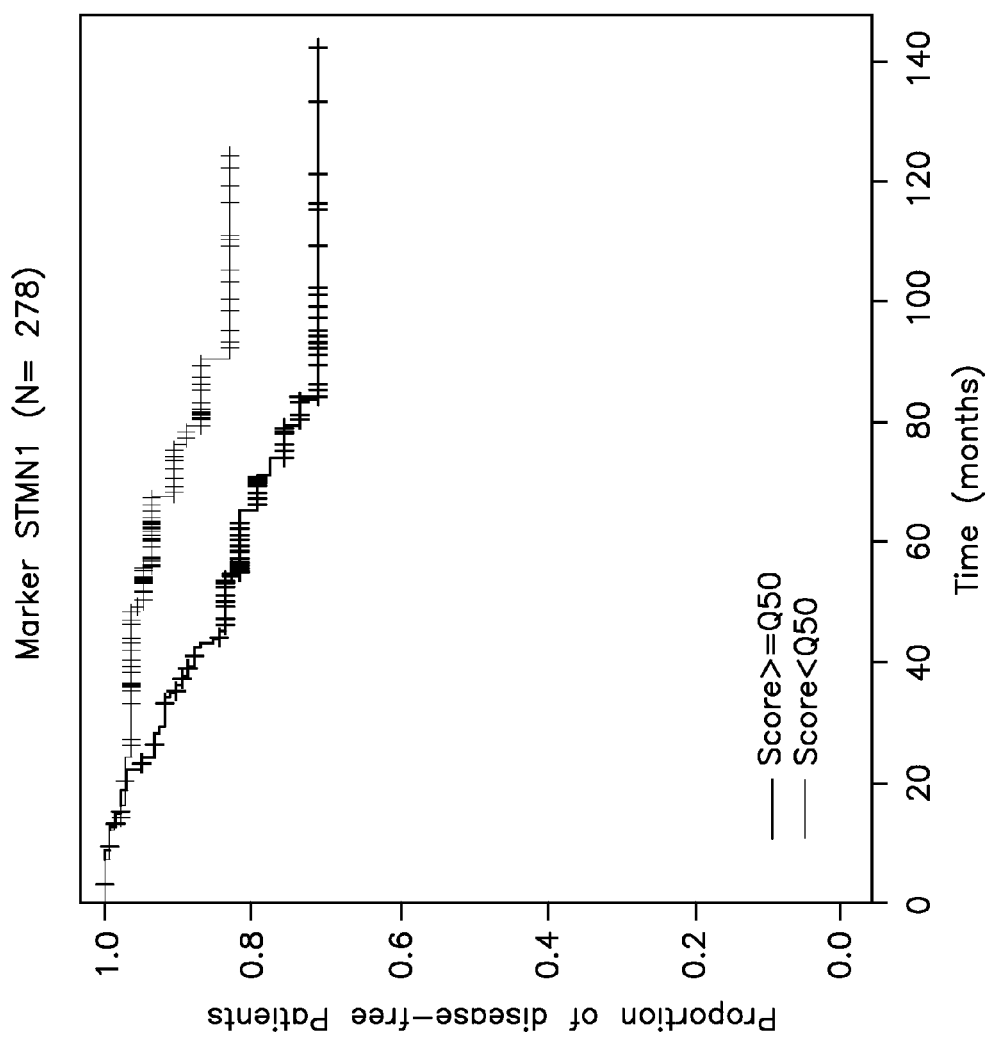
Figure 8:
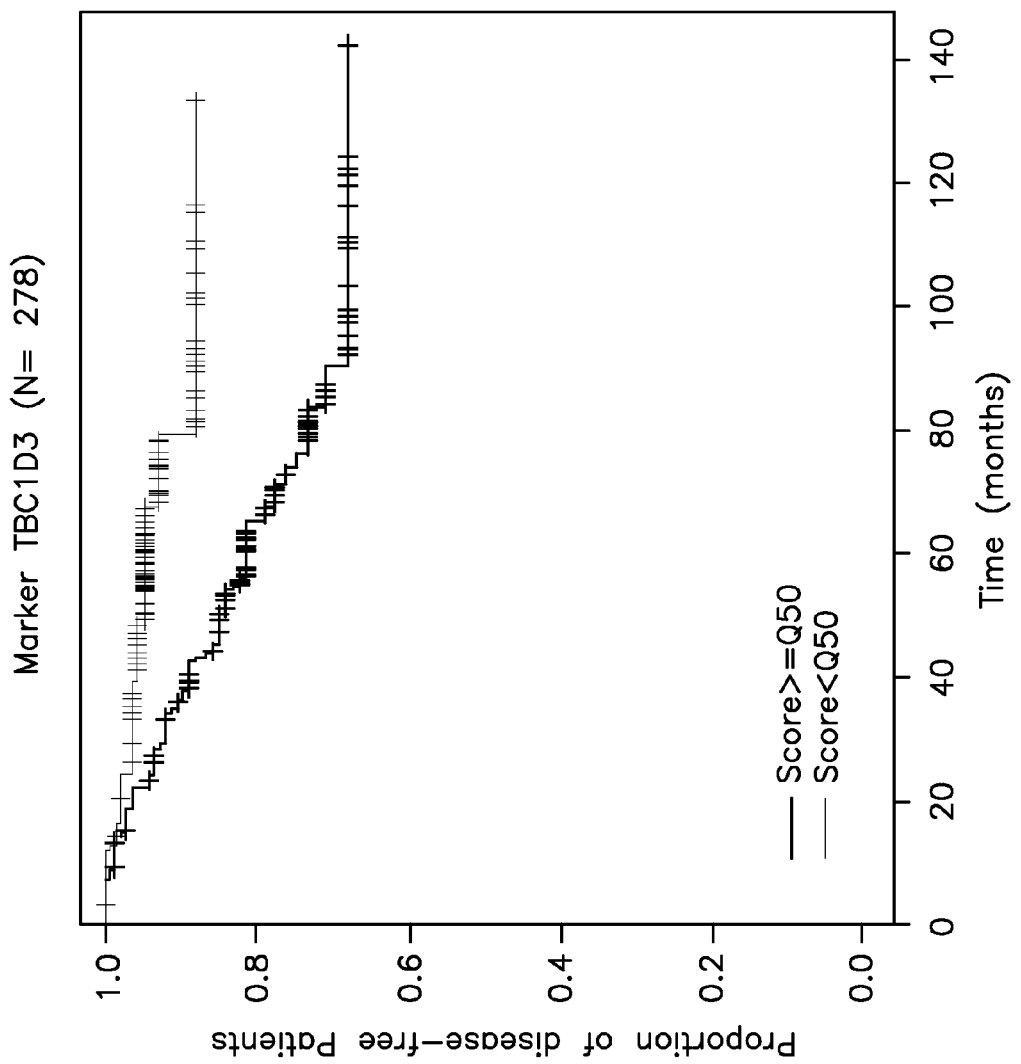
Figure 9:
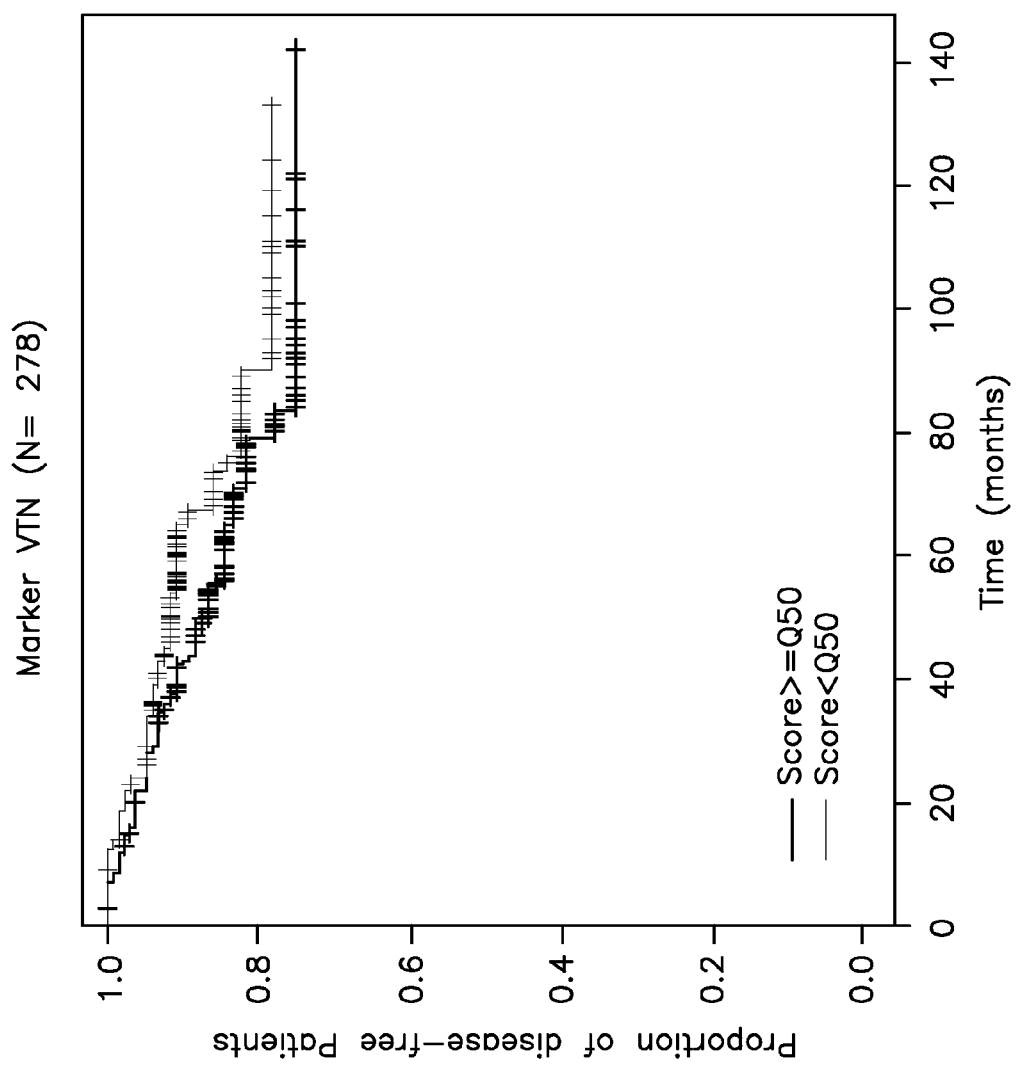
Figure 10:
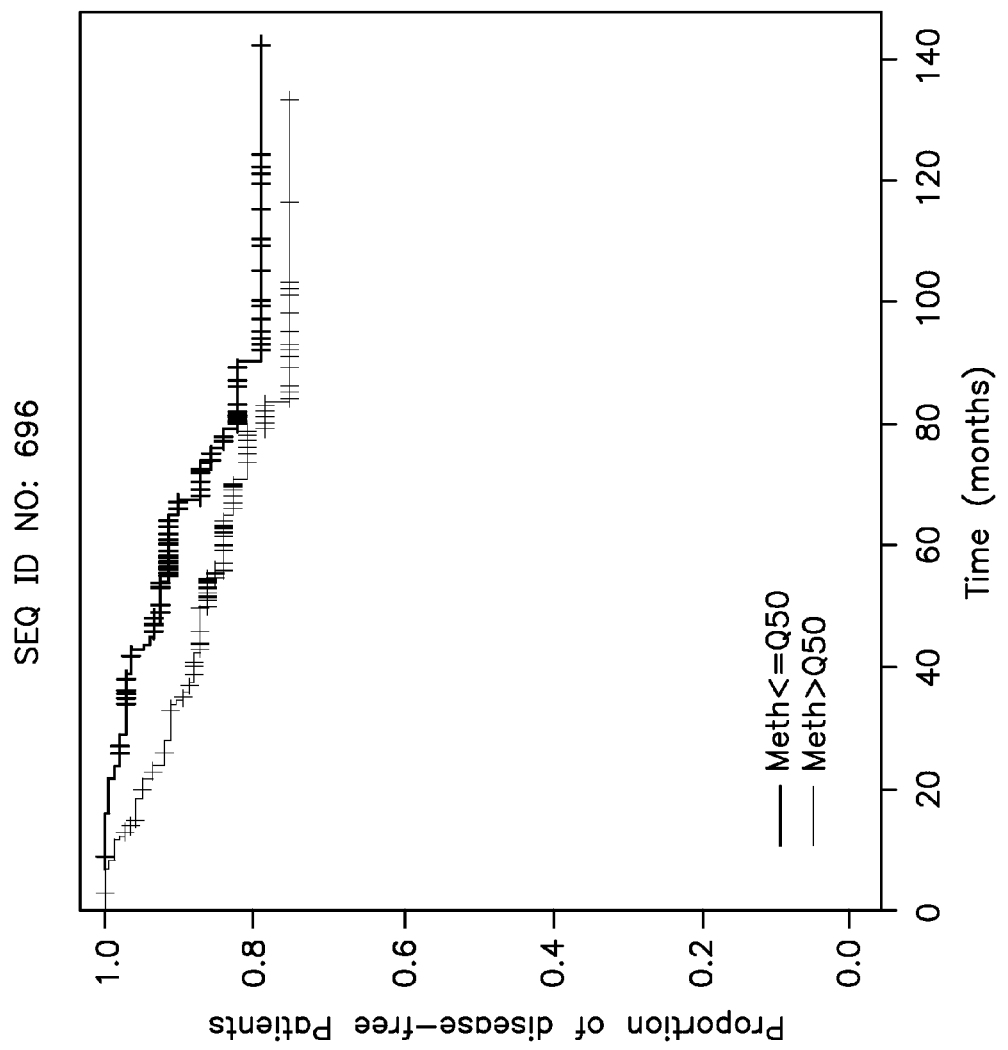
Figure 11:
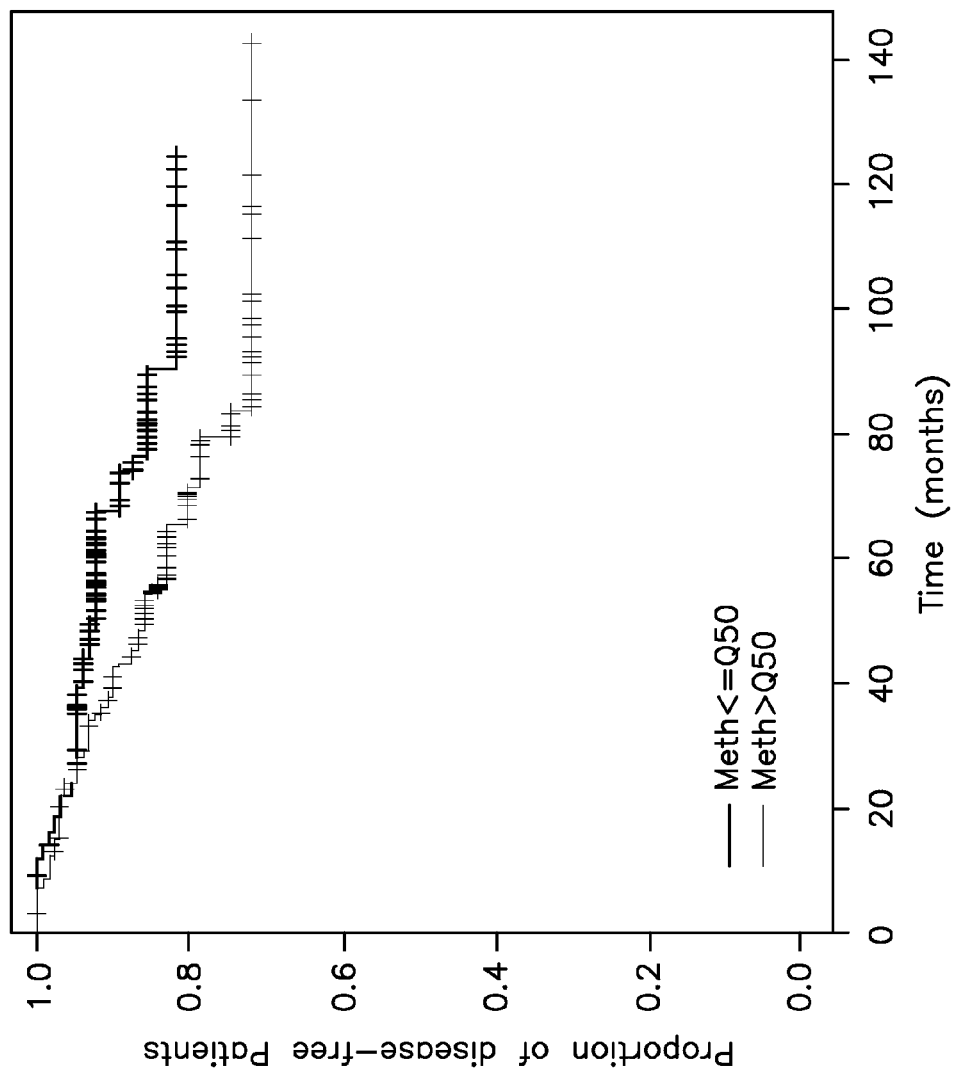
Figure 12:
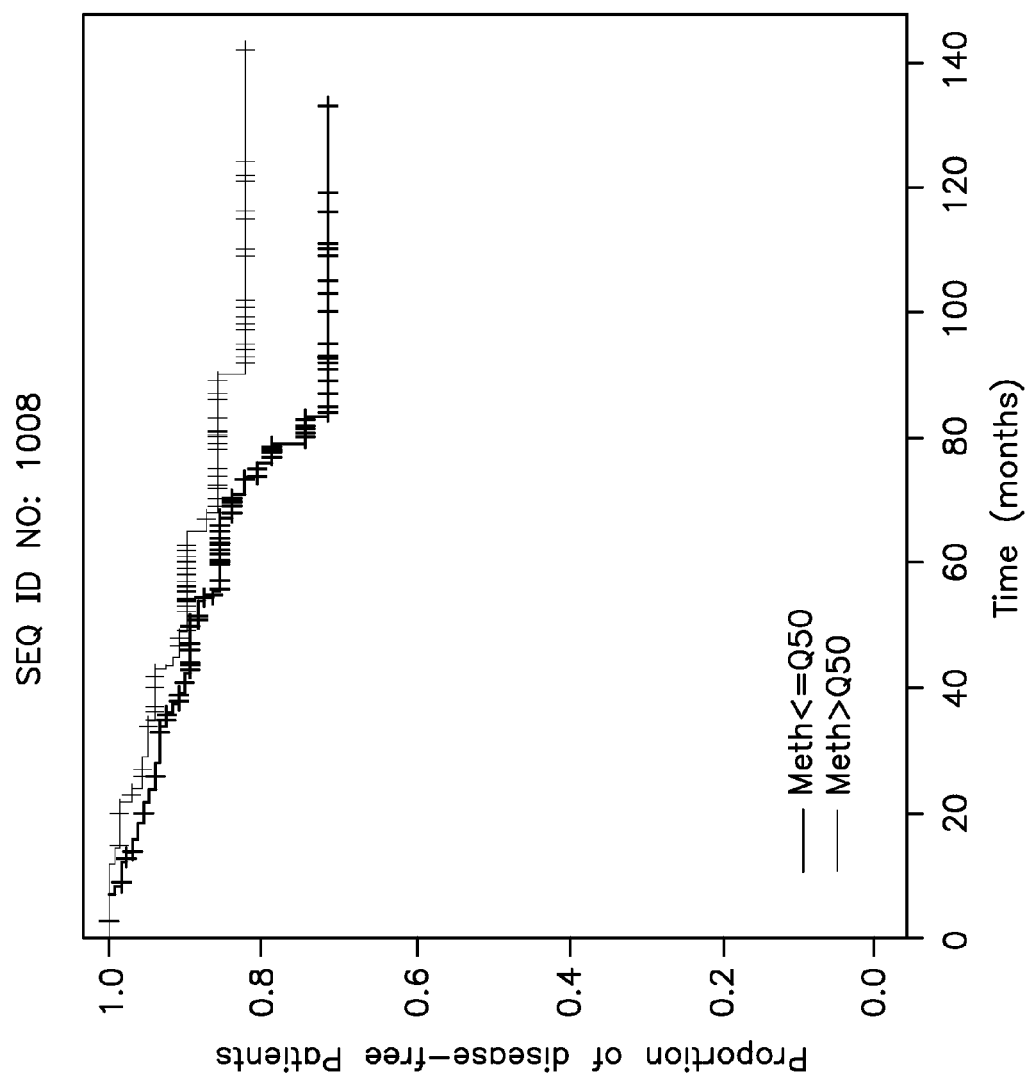
Figure 13:
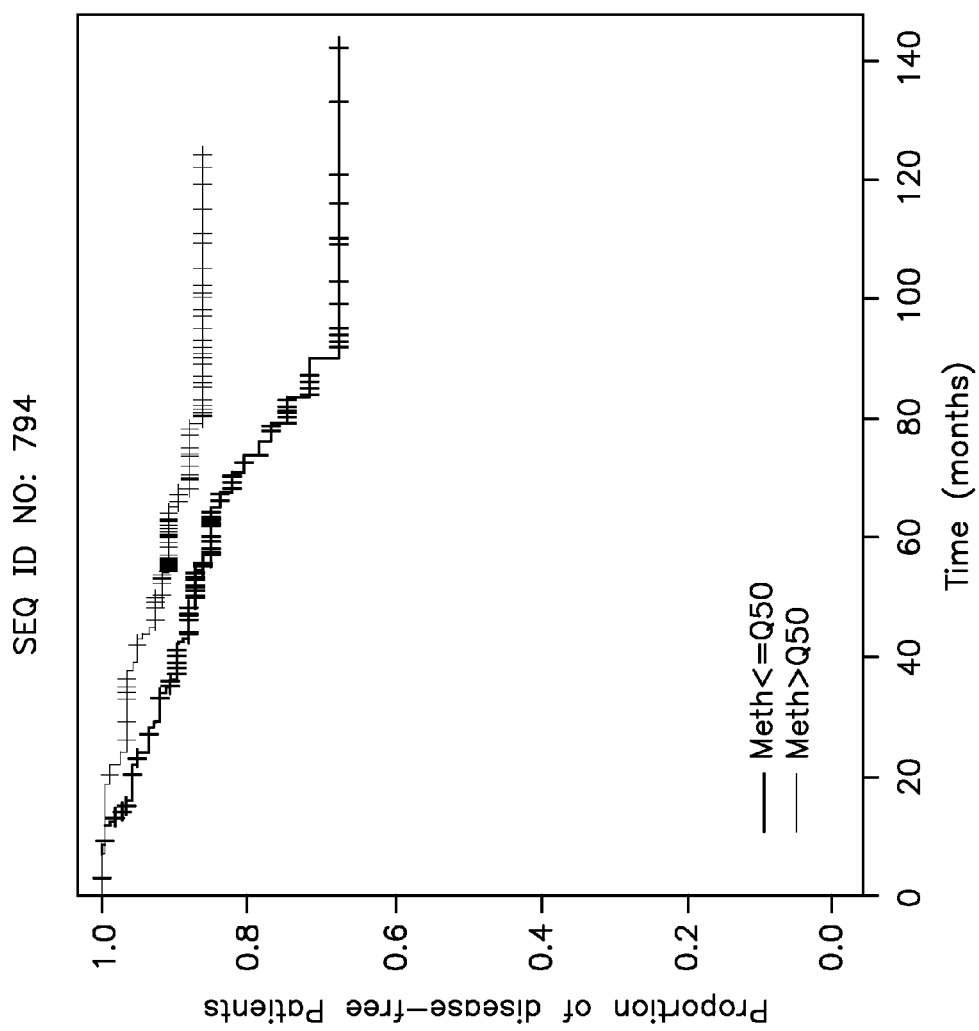
Figure 14:
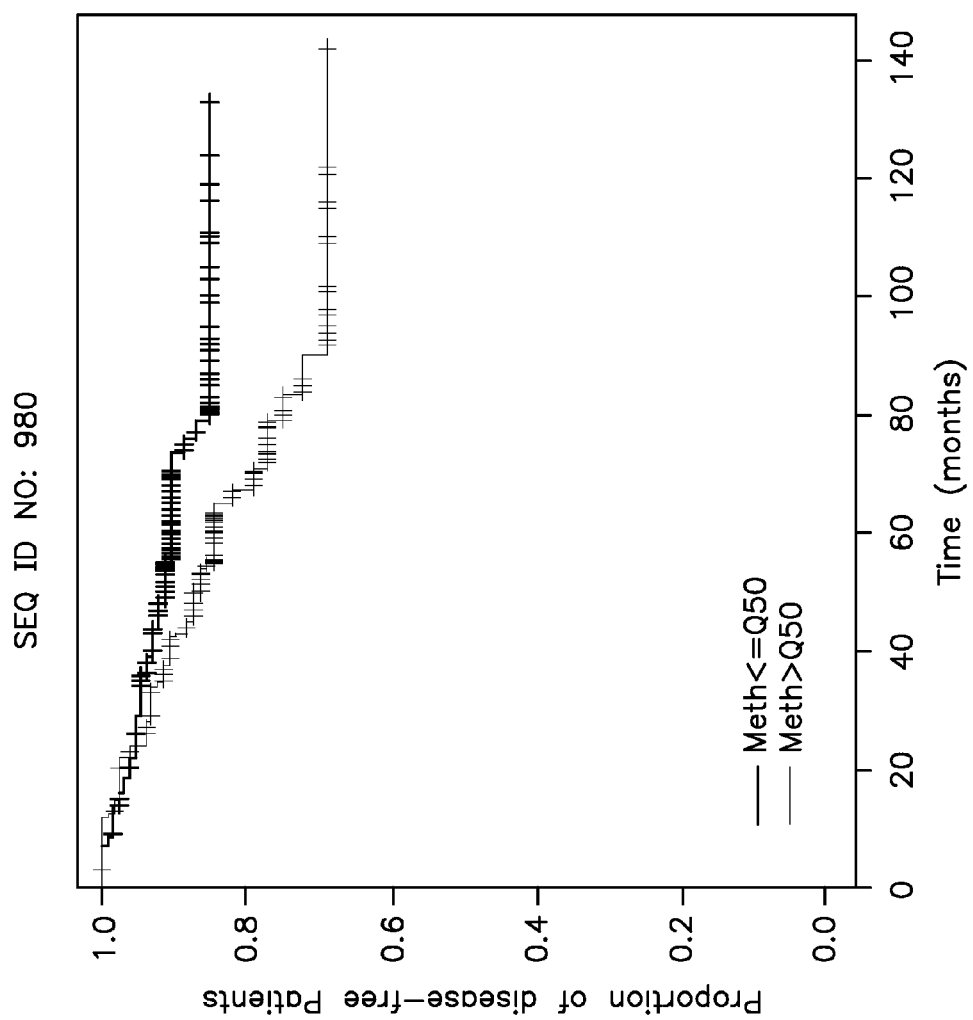
Figure 15:
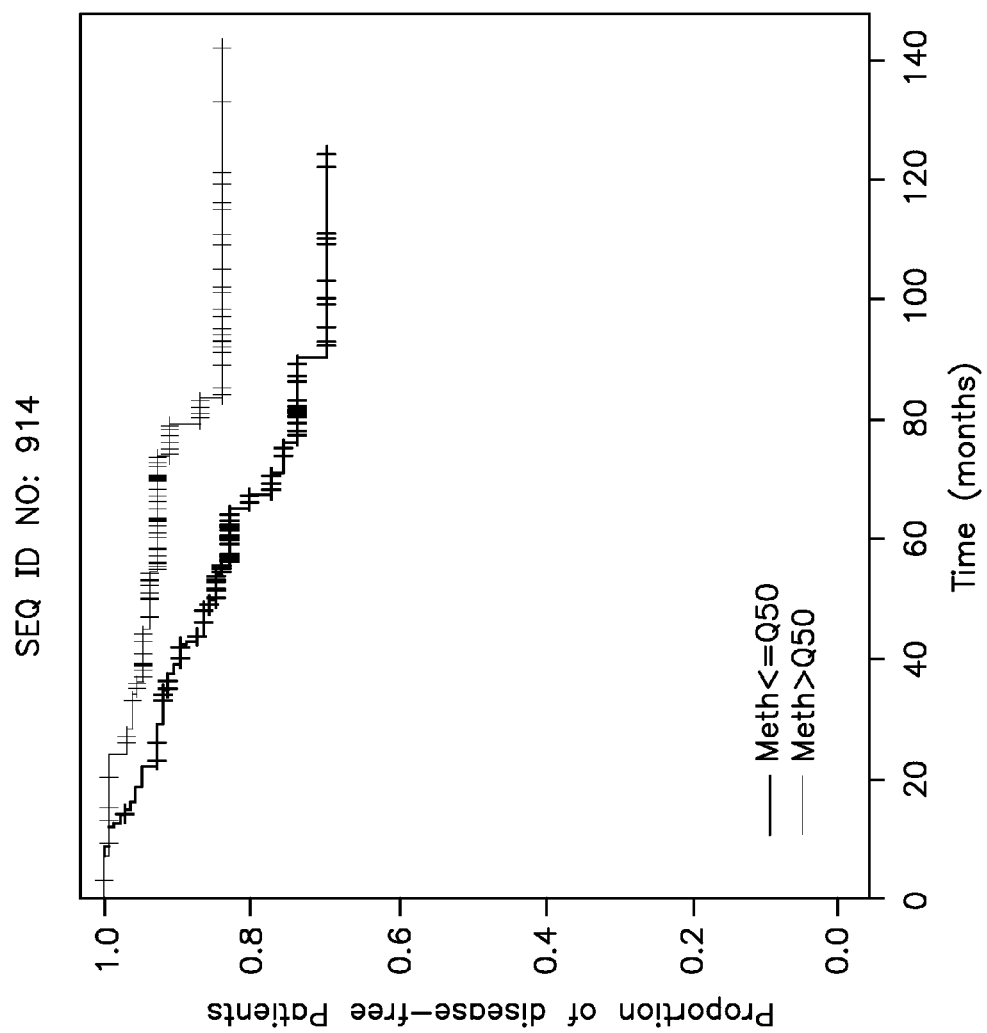
Figure 16:
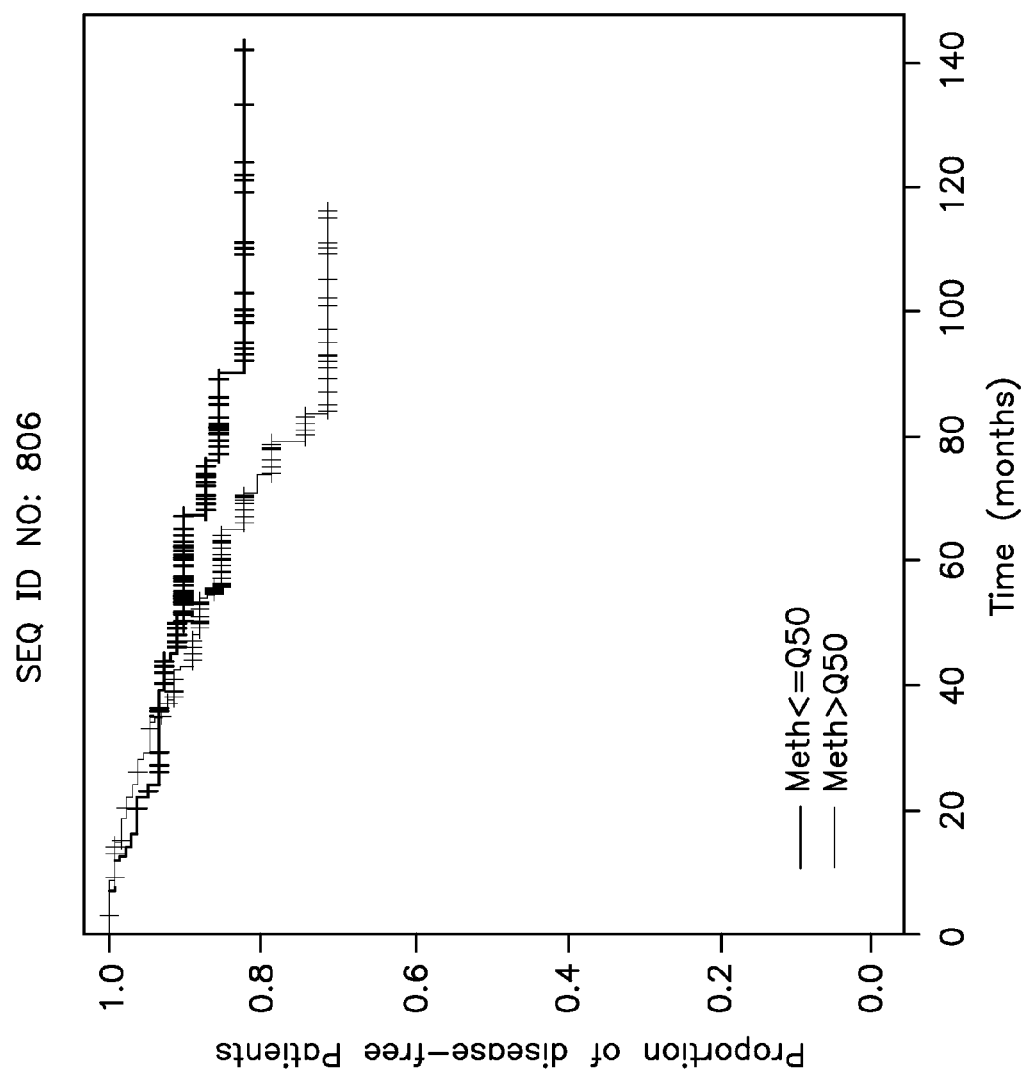
Figure 17:
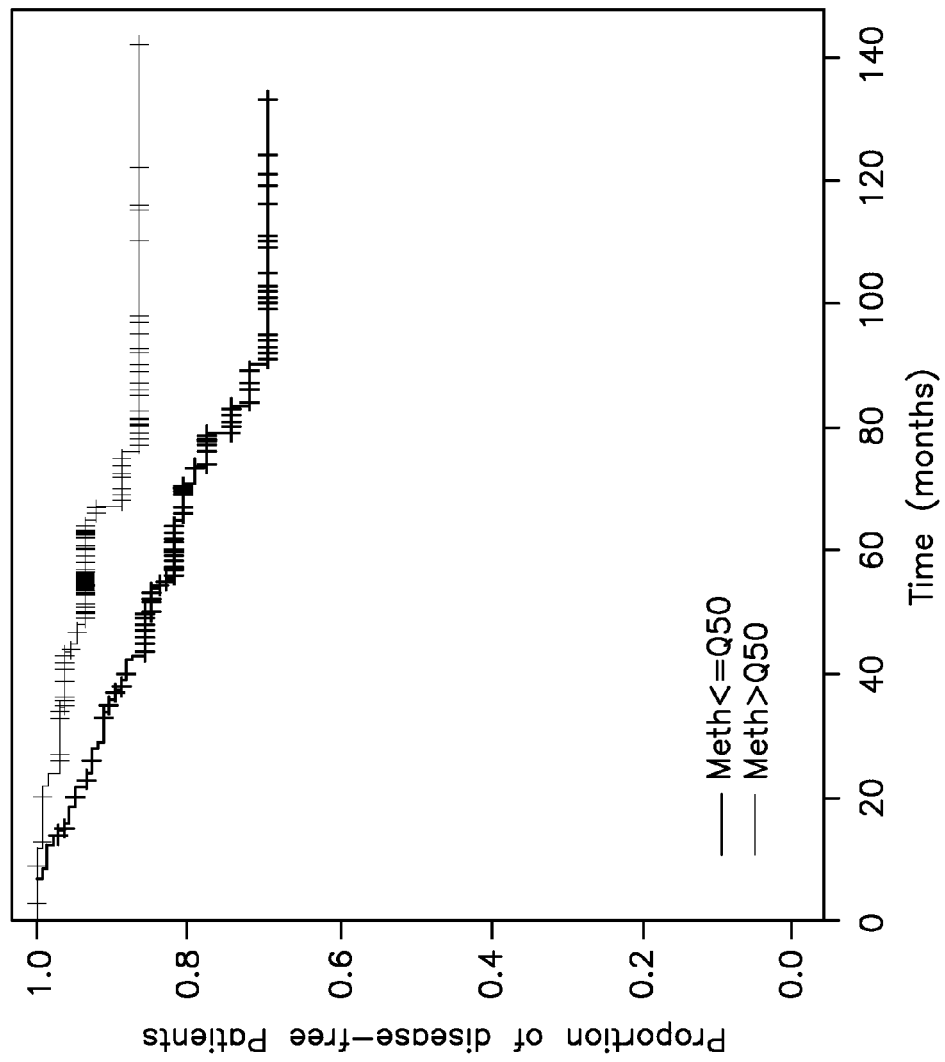
Figure 18:
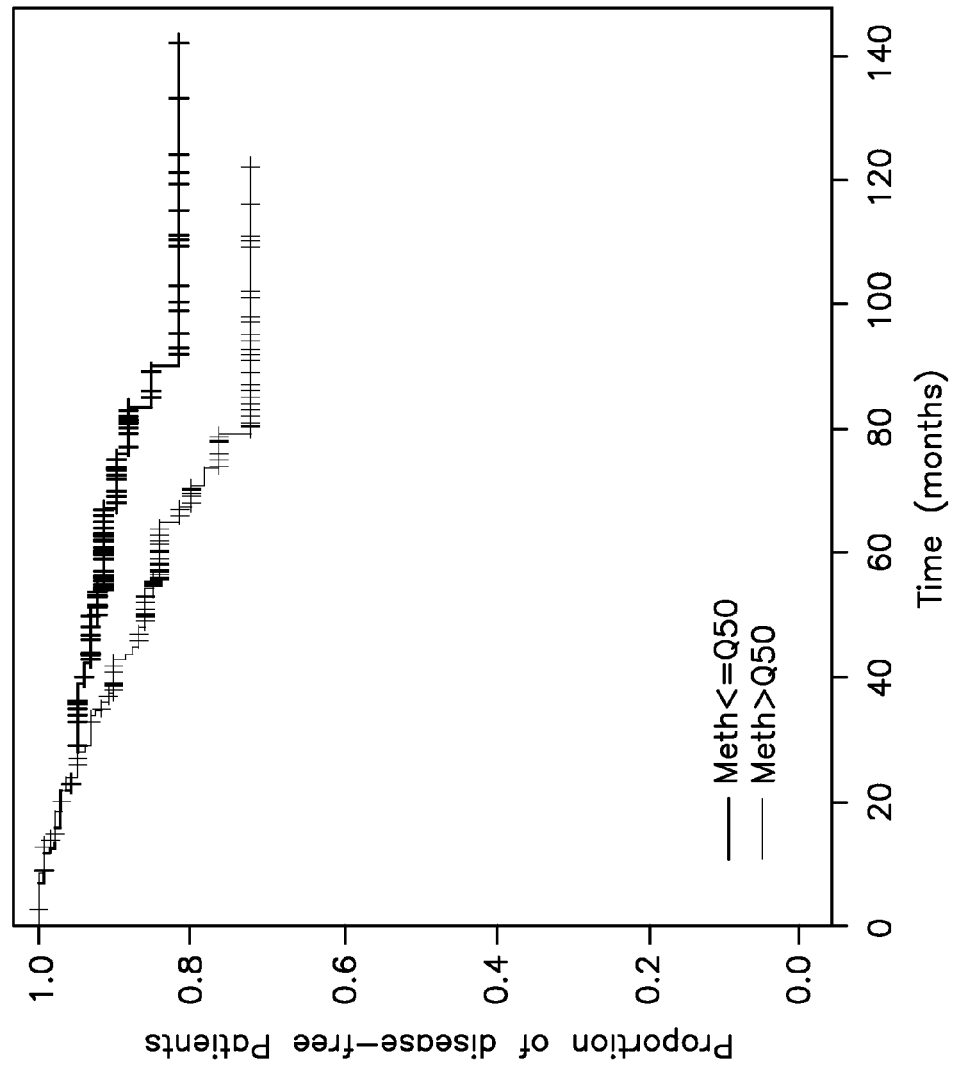
Figure 19:
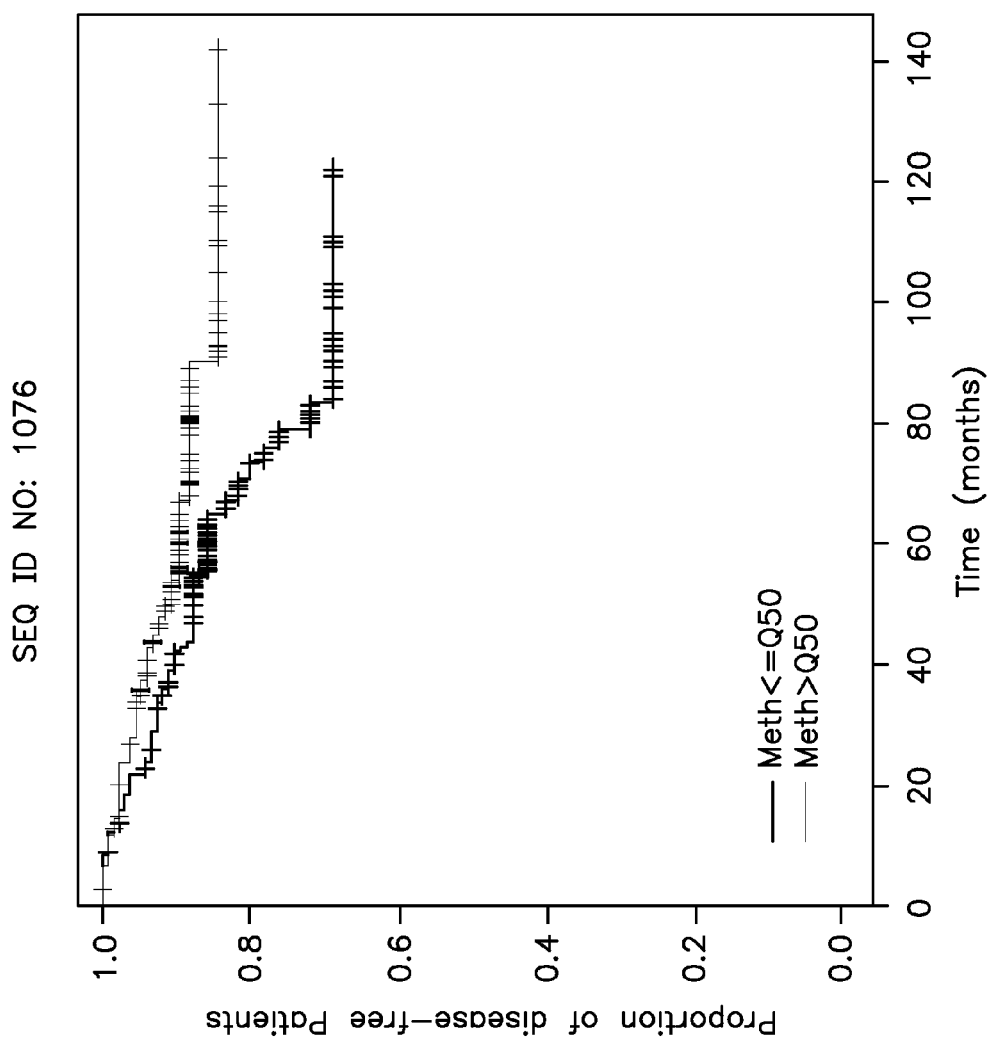
Figure 20:
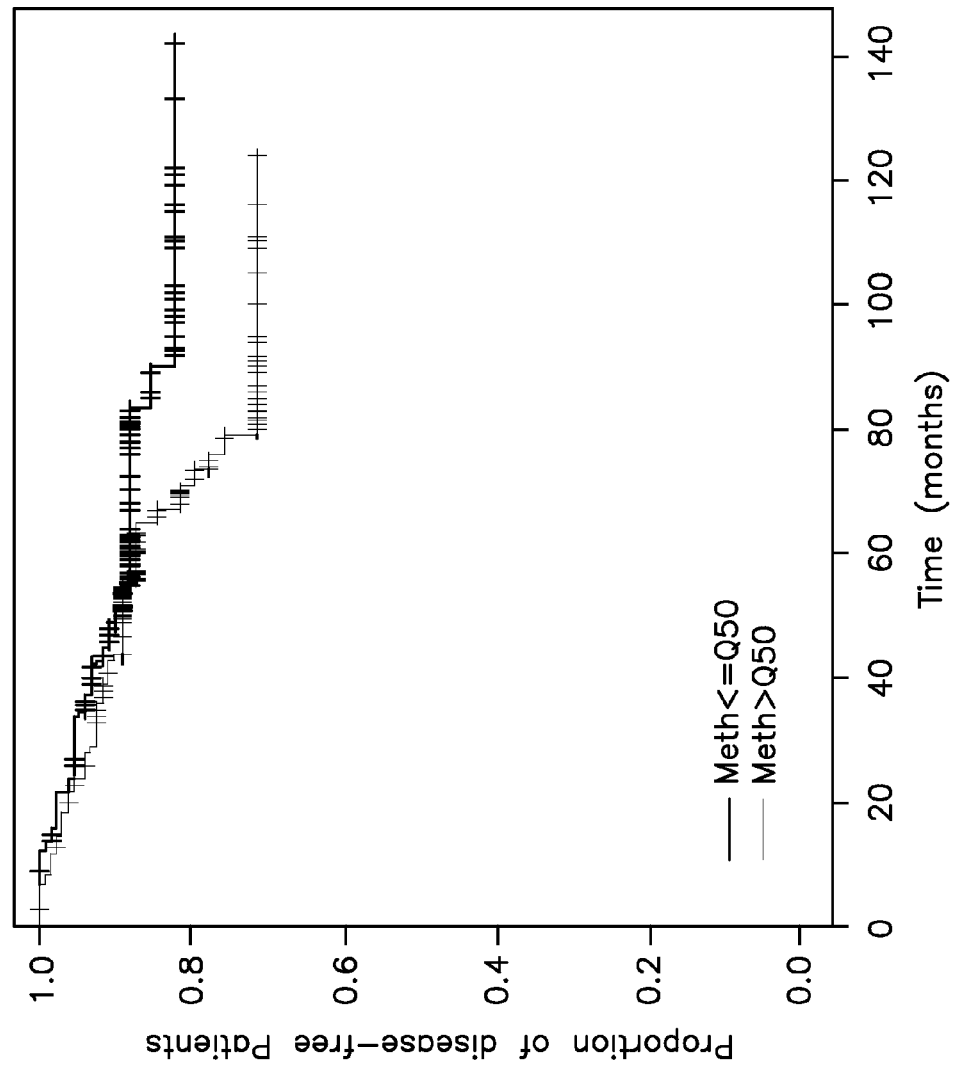
Figure 21:
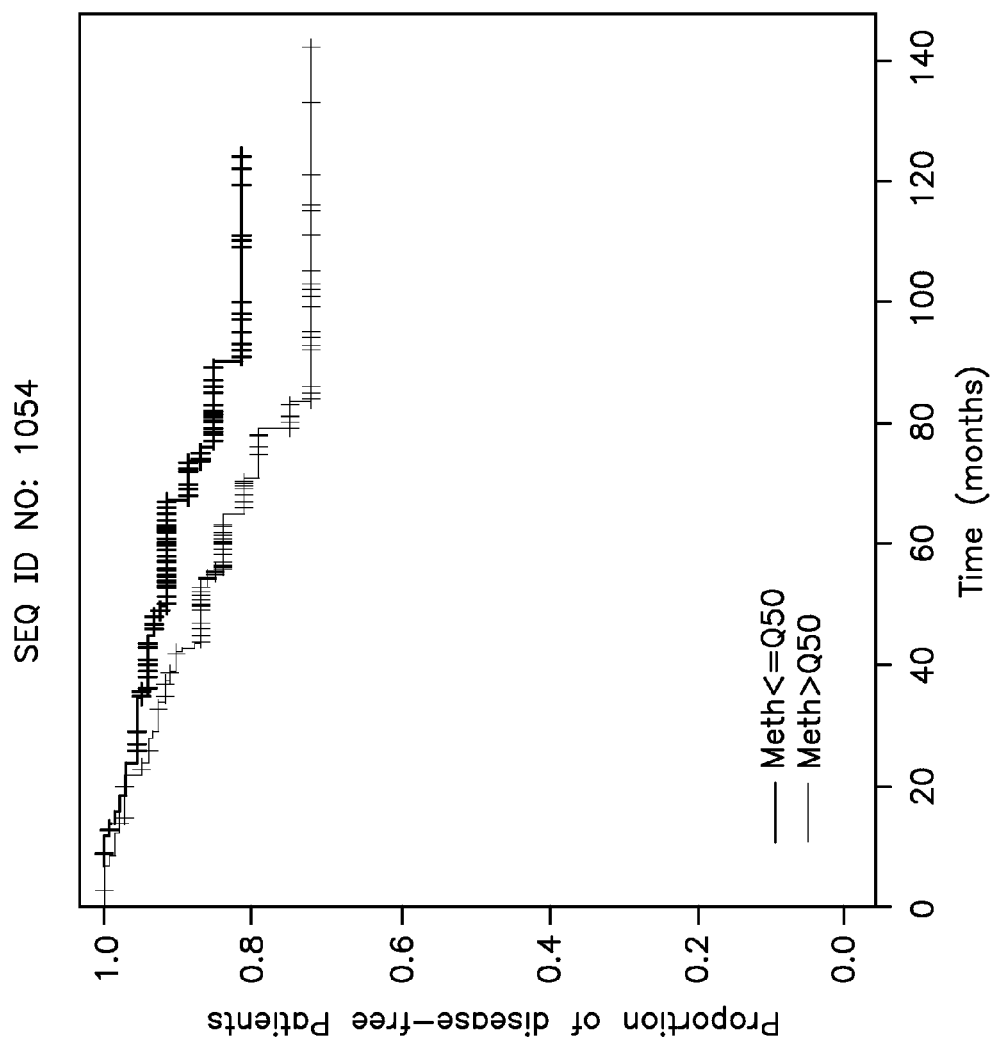
Figure 22:
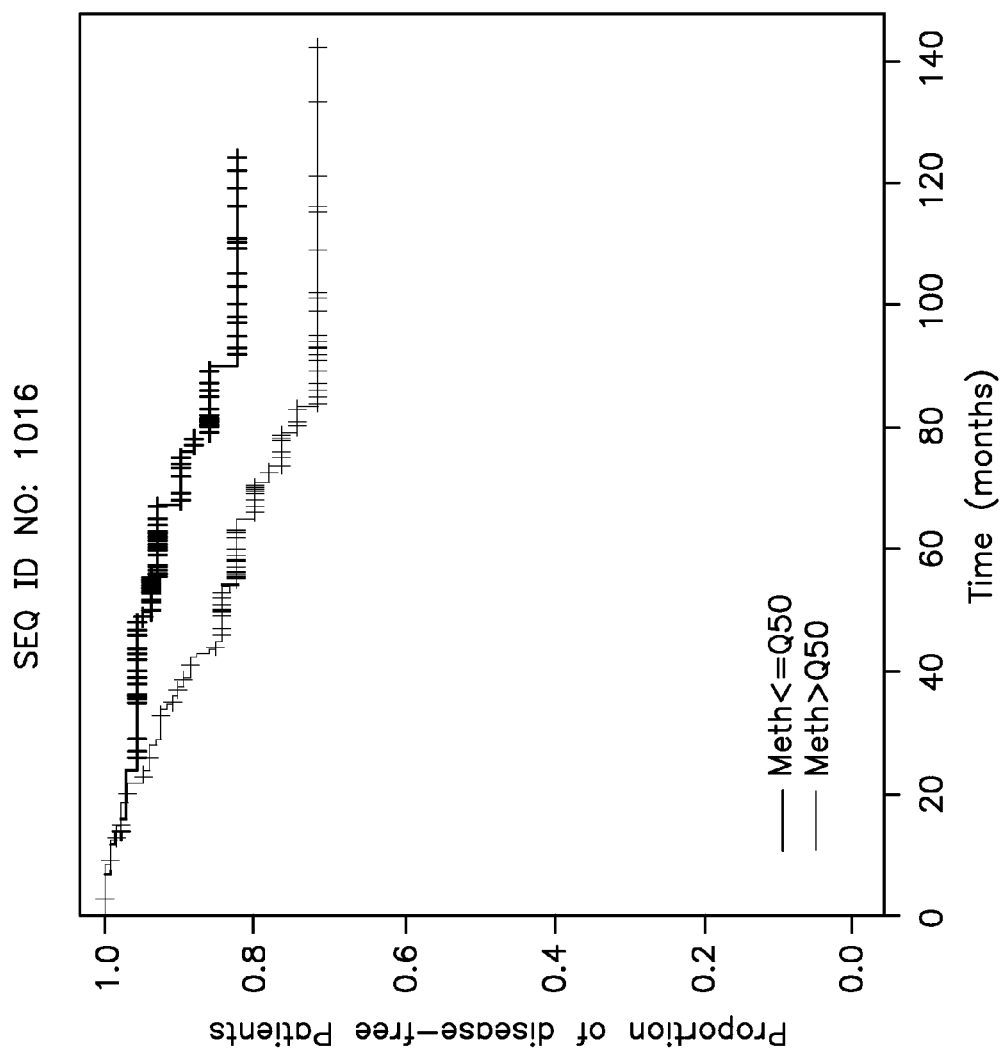
Figure 23:
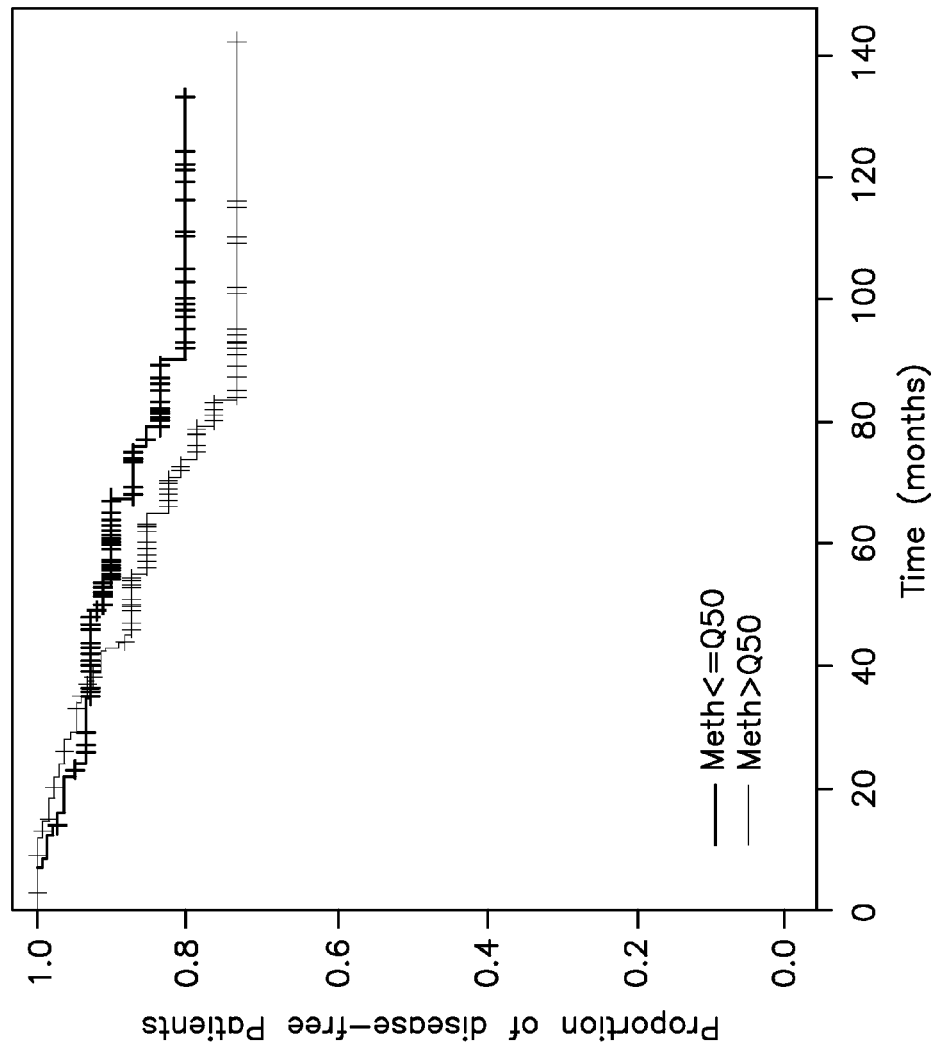
Figure 24:
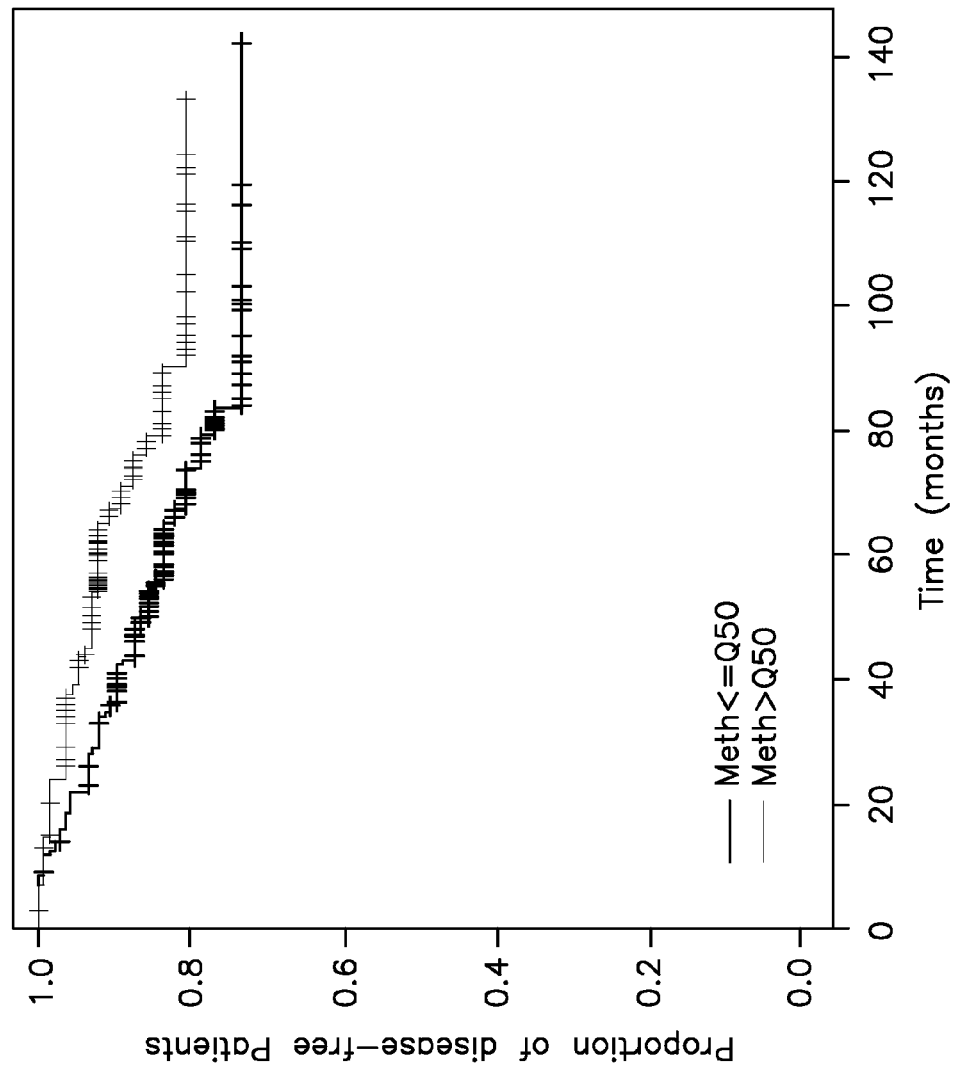
Figure 25:
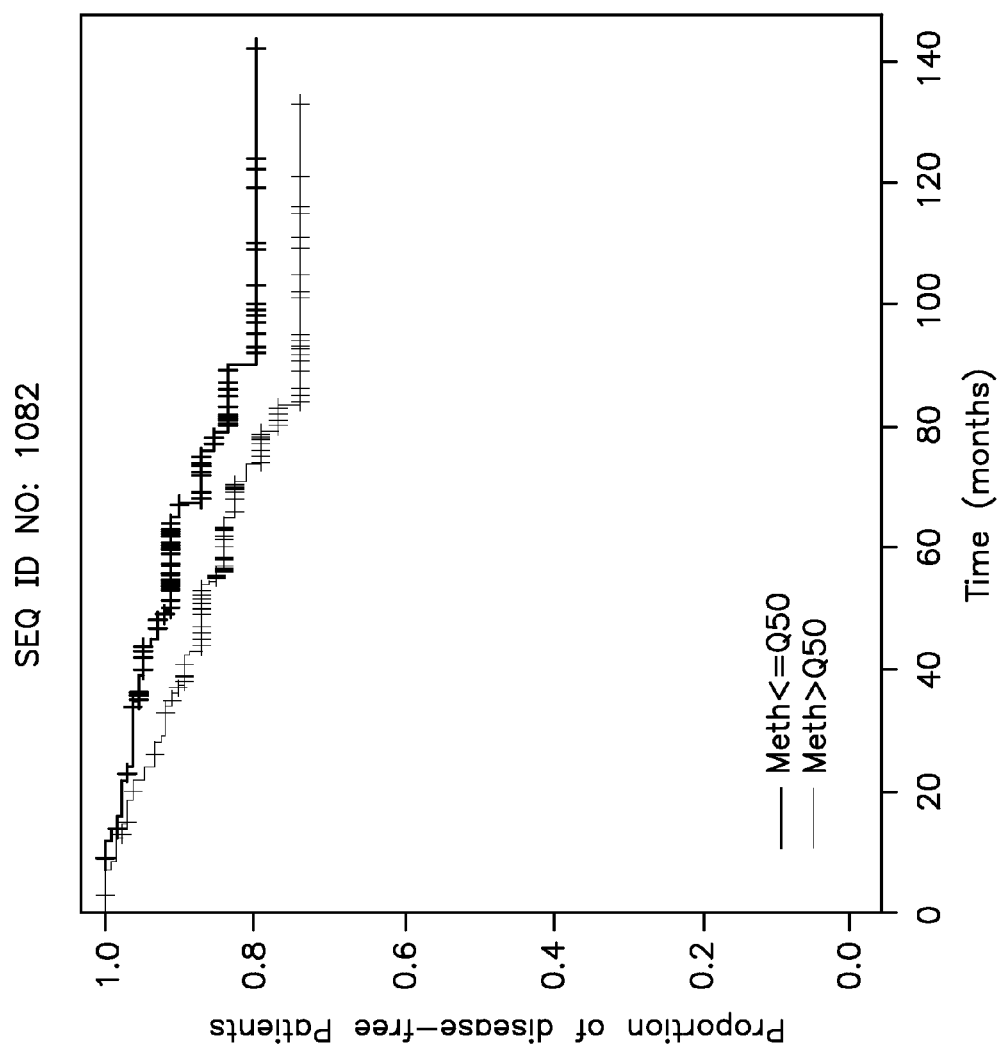
Figure 26:
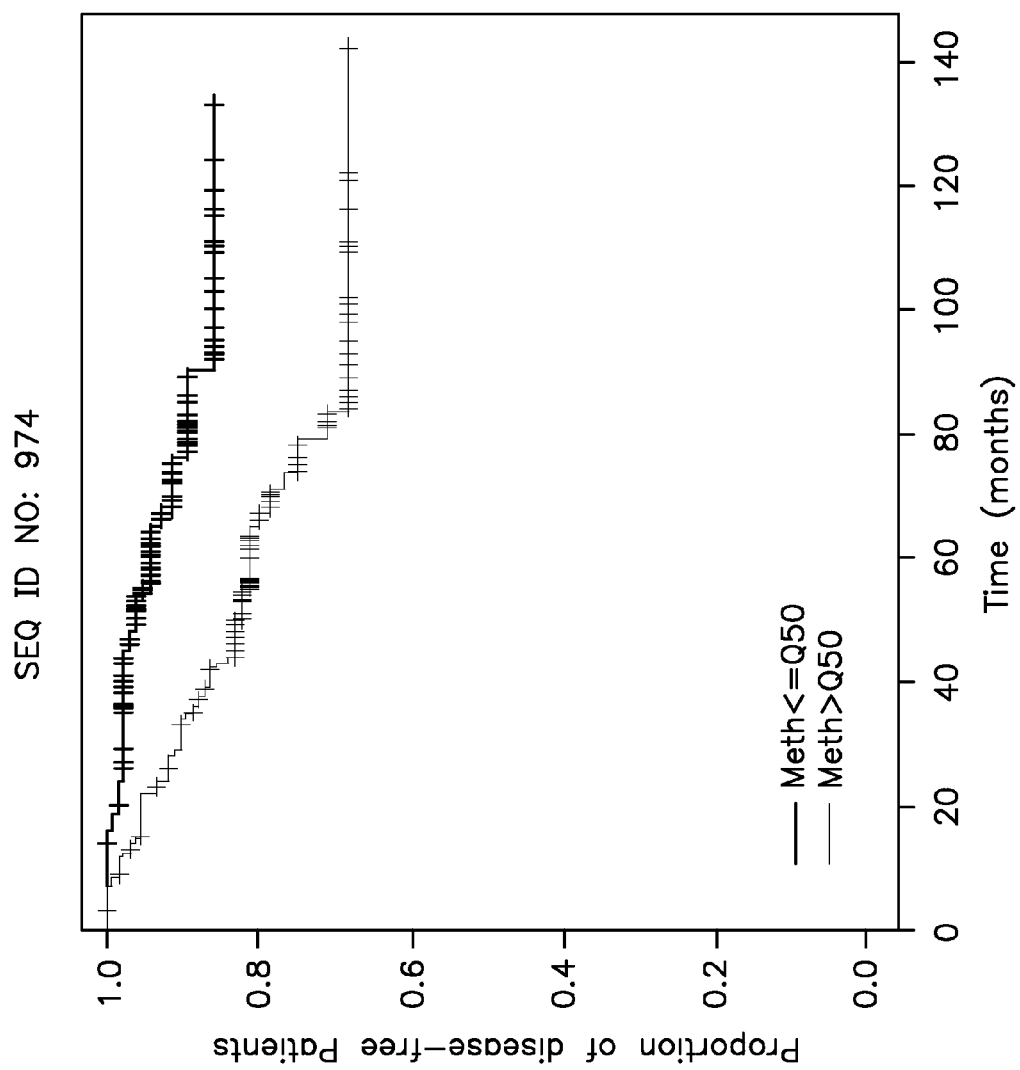
Figure 27:
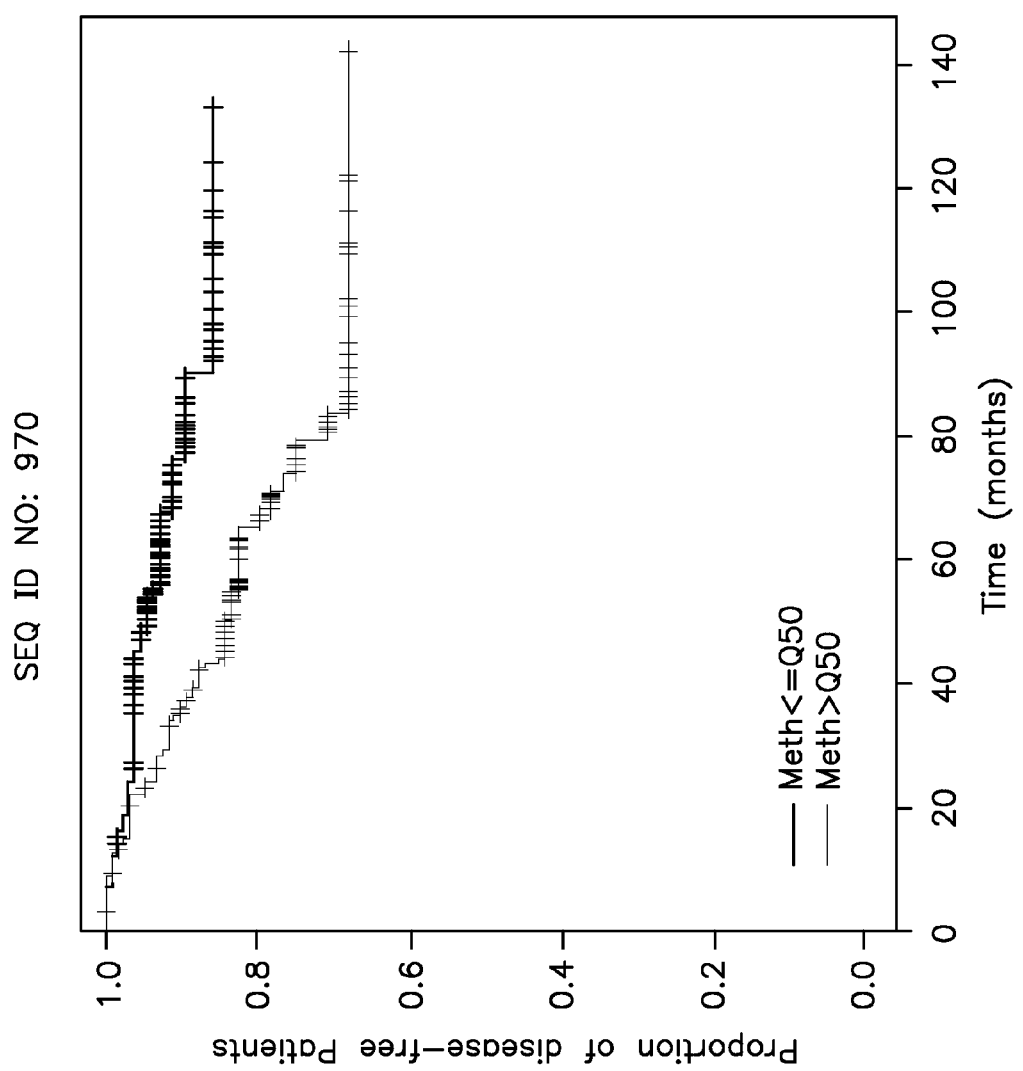
Figure 28:
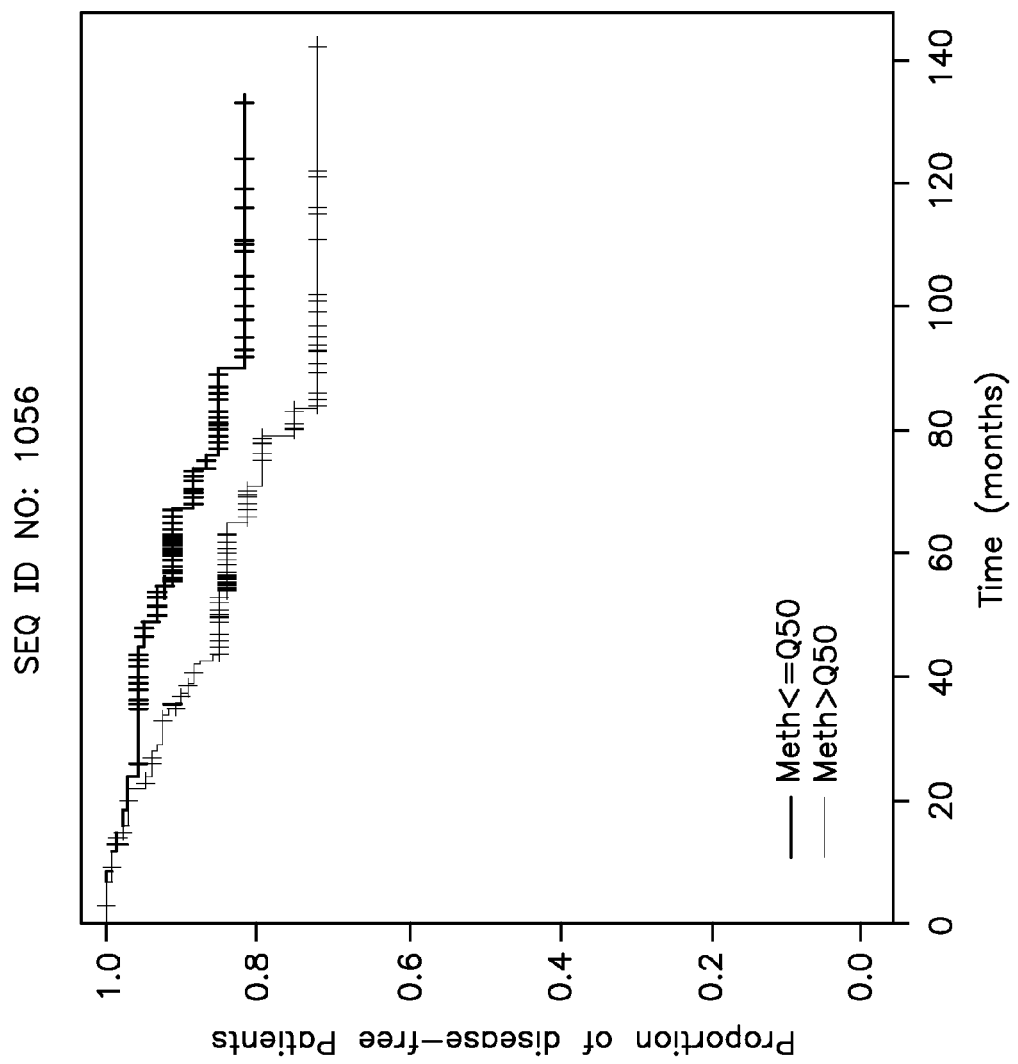
Figure 29:
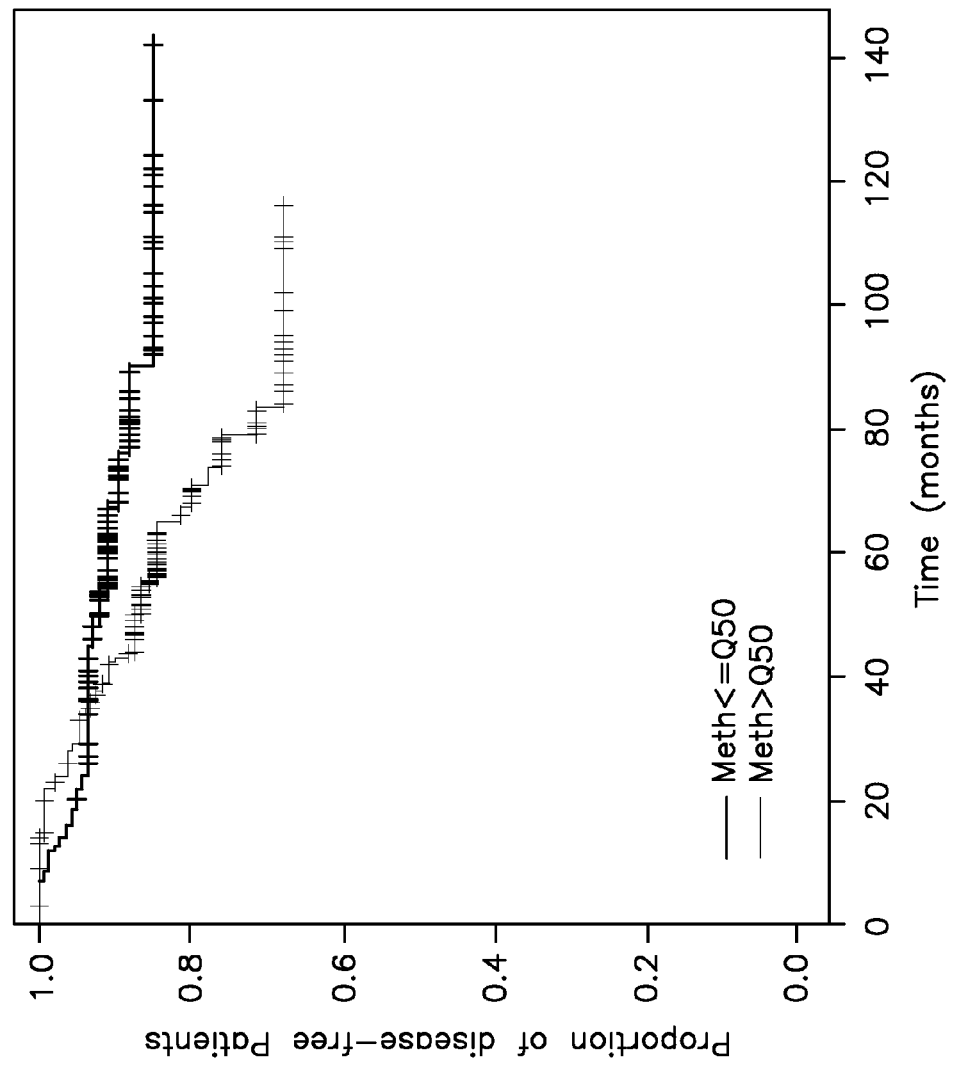
Figure 30:
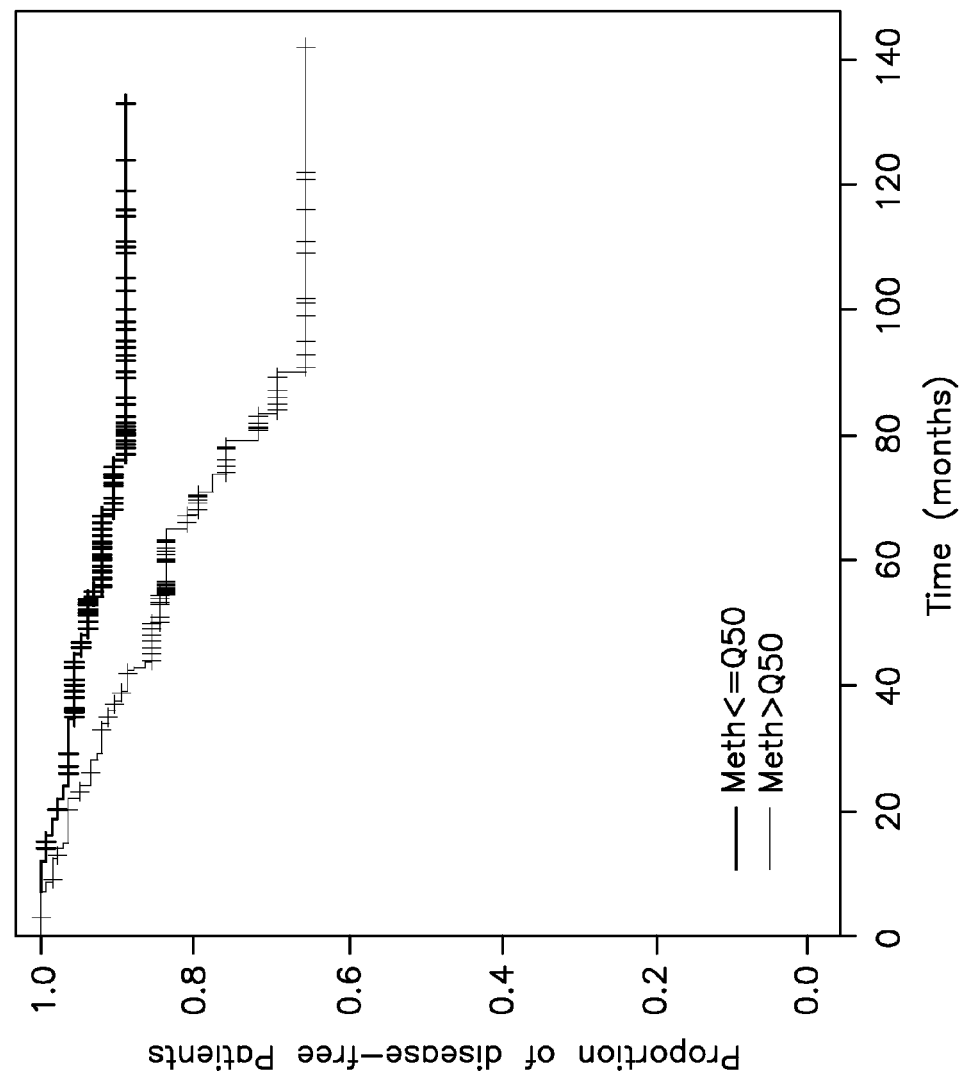
Figure 31:
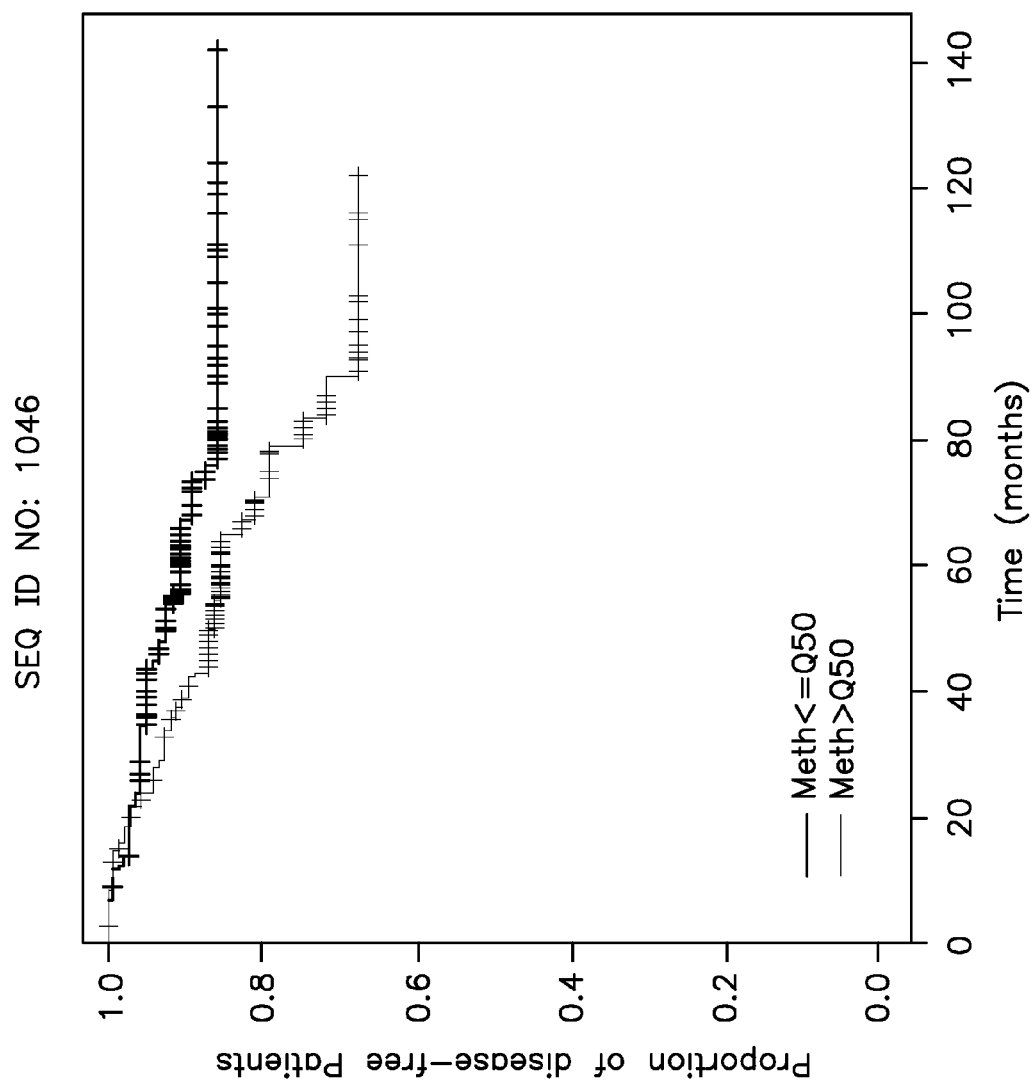
Figure 32:
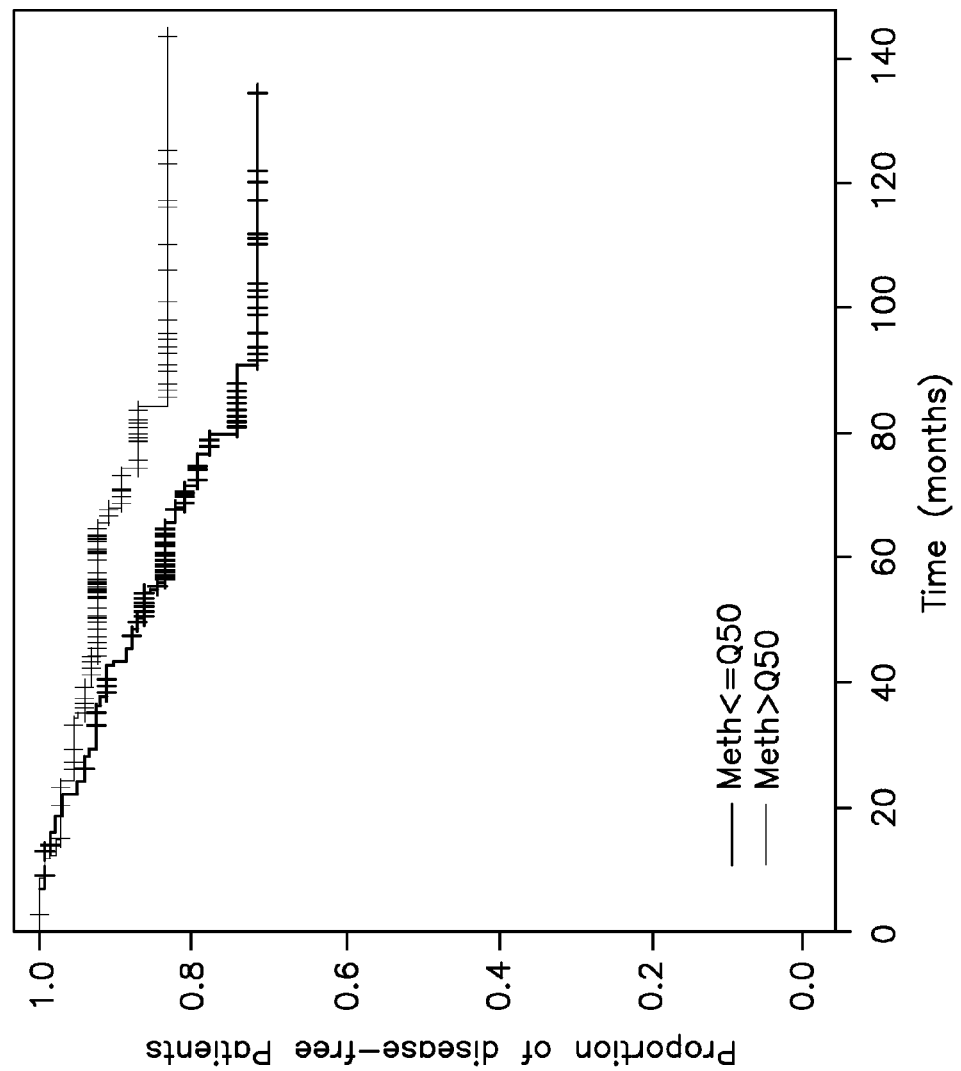
Figure 33:
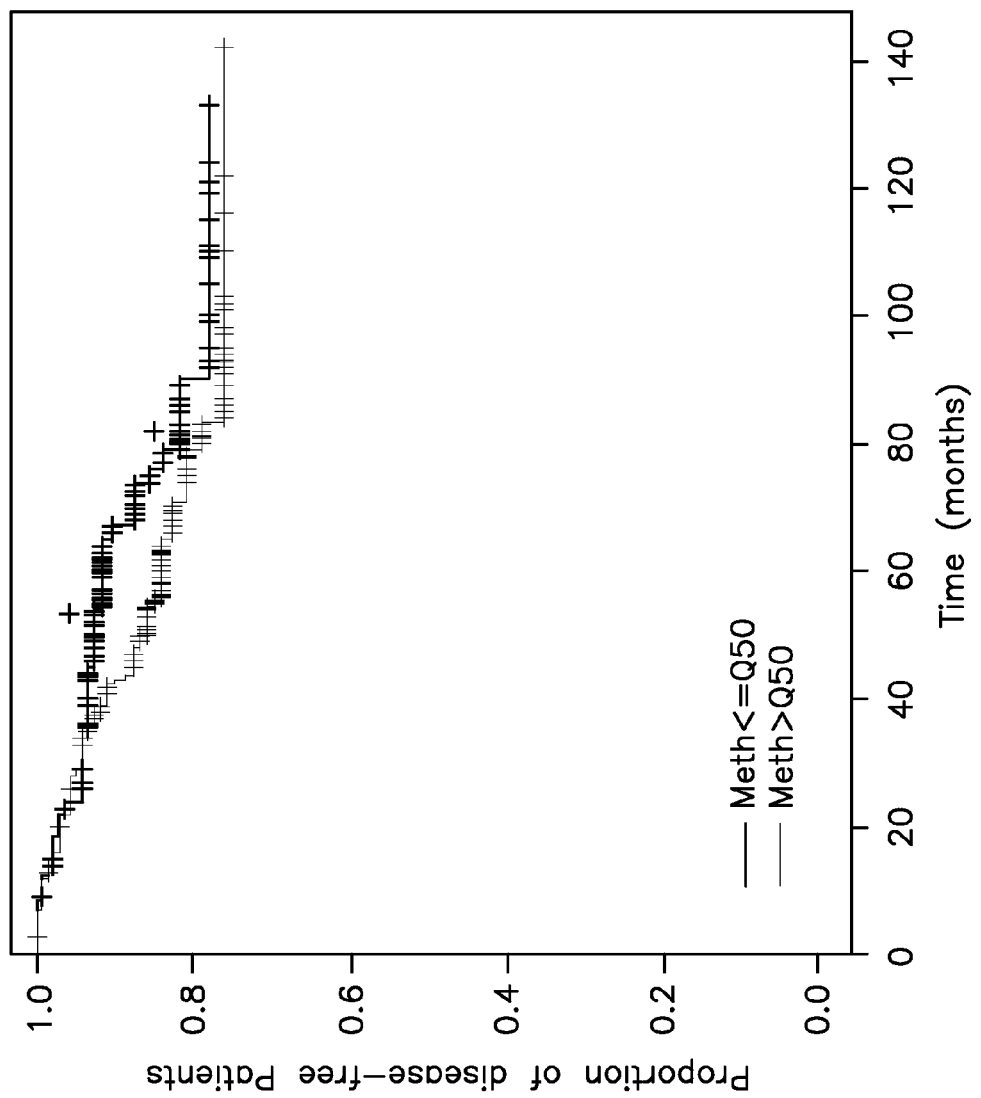
Figure 34:
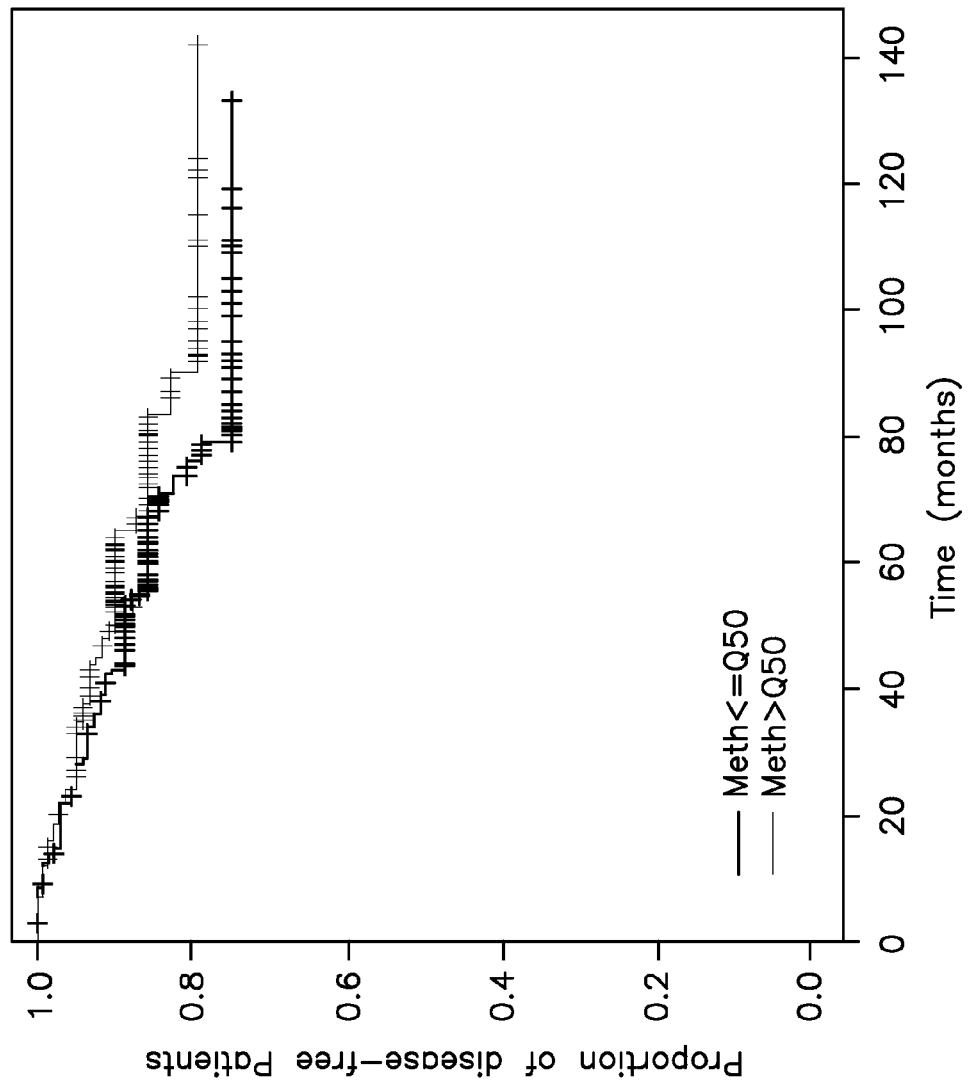
Figure 35:
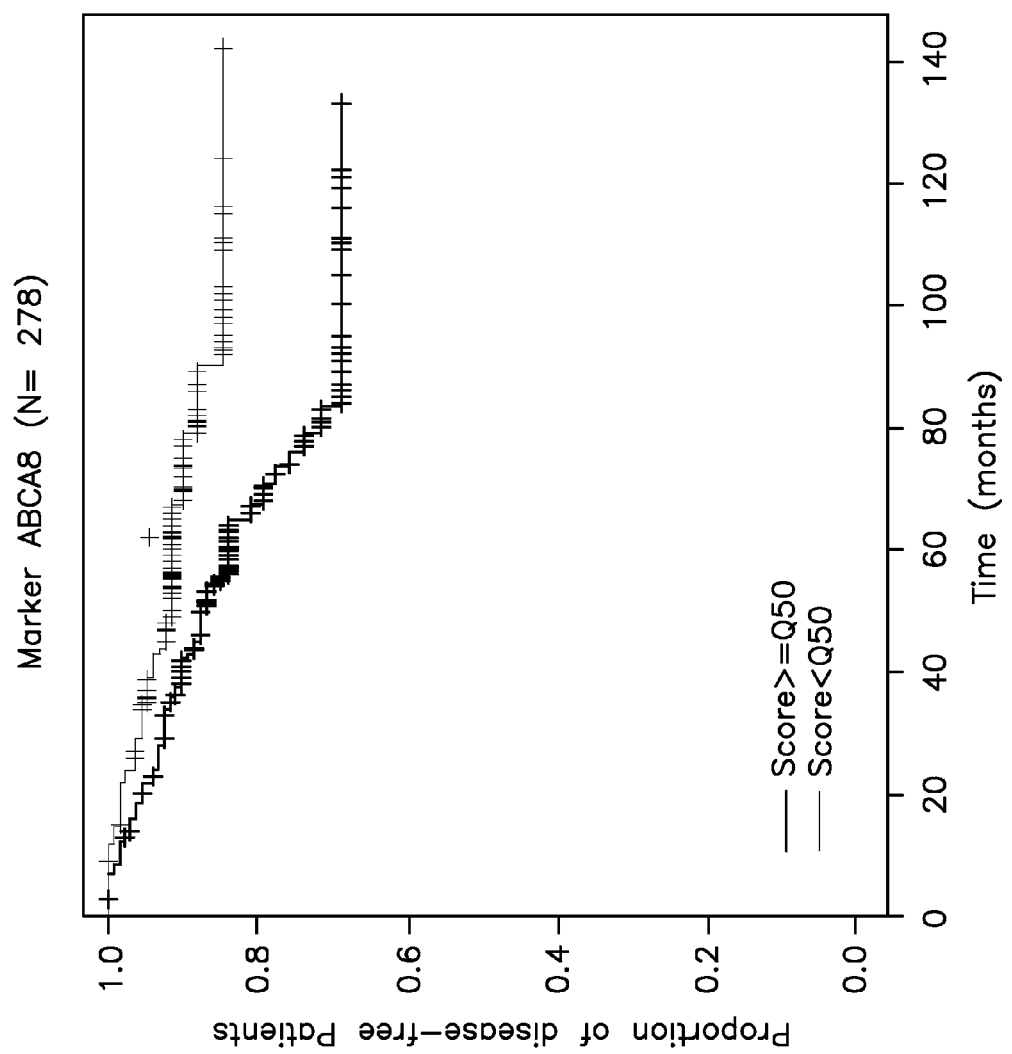
Figure 36:
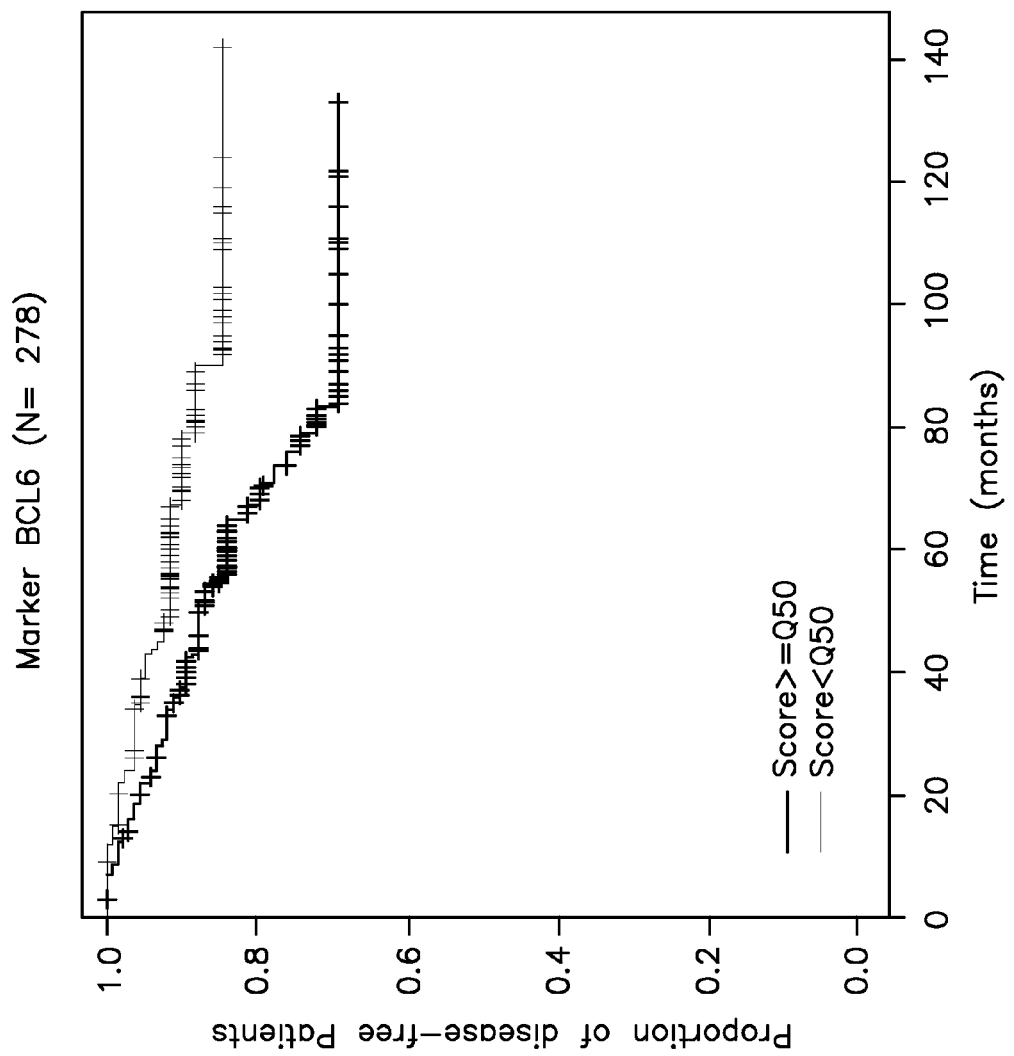
Figure 37:
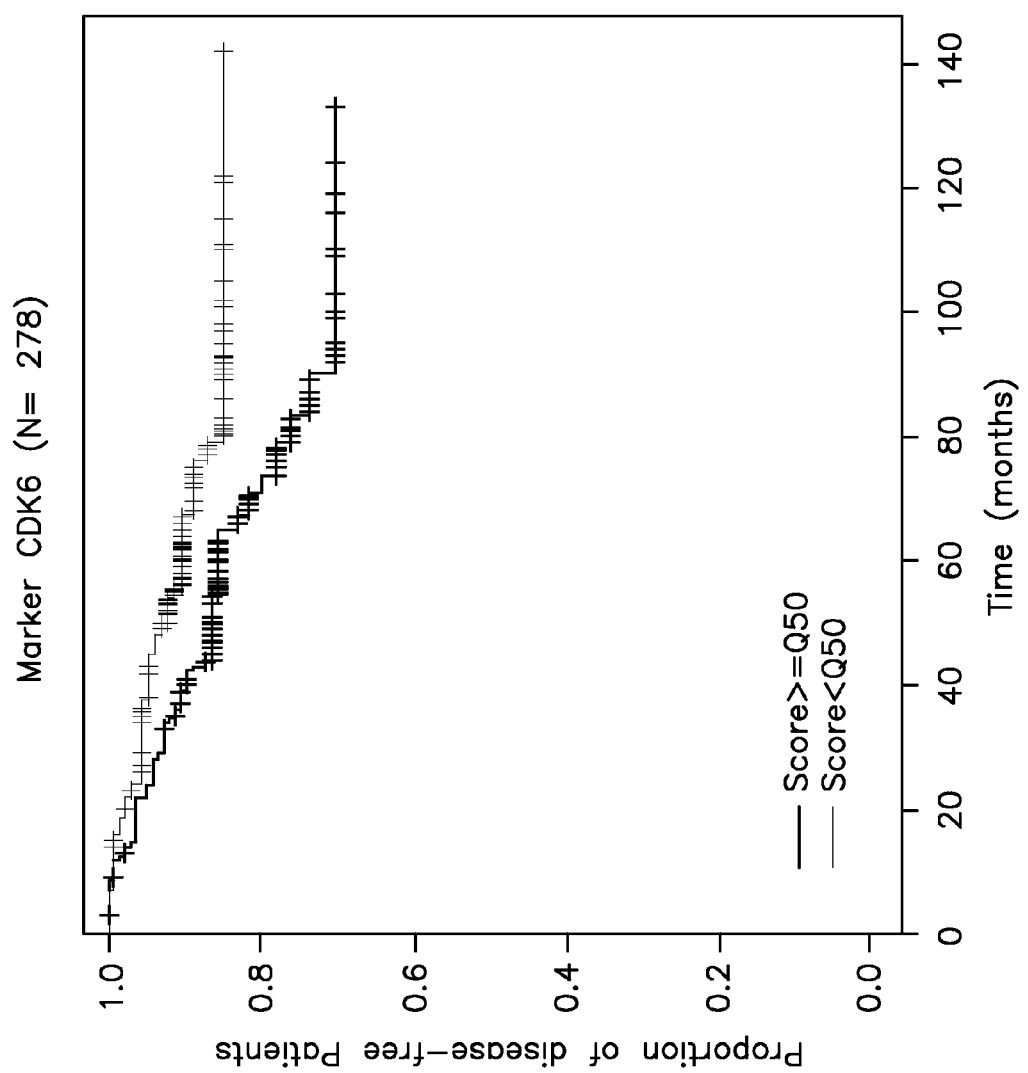
Figure 38:
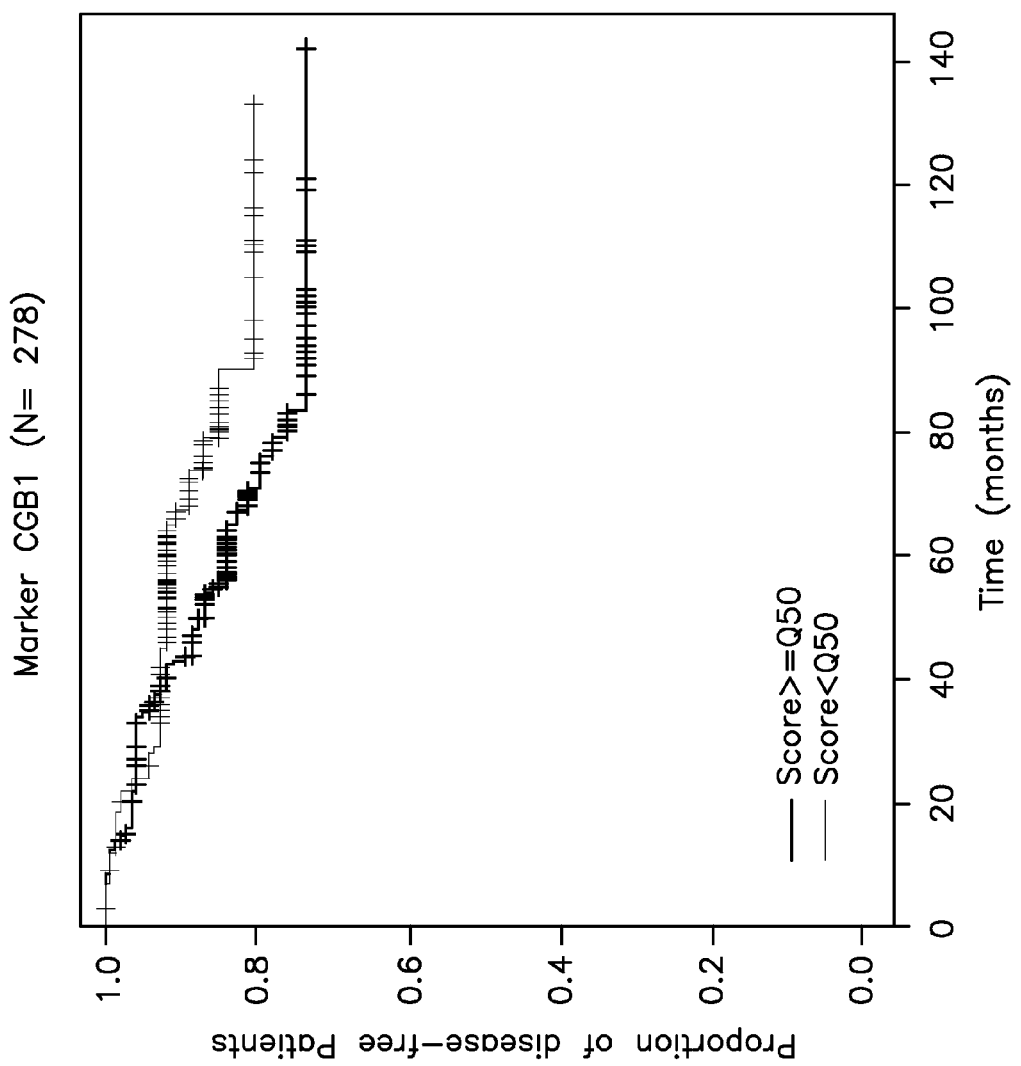
Figure 39:
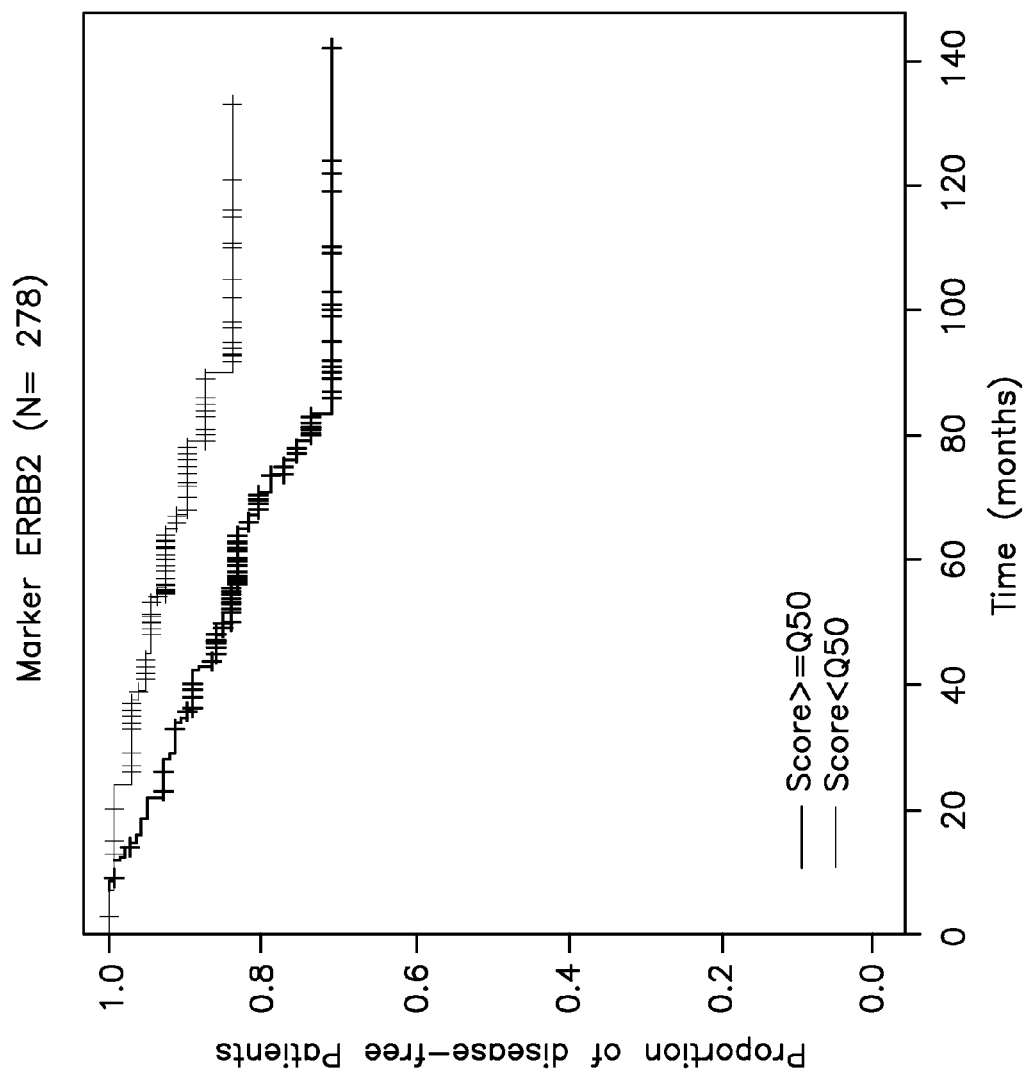
Figure 40:
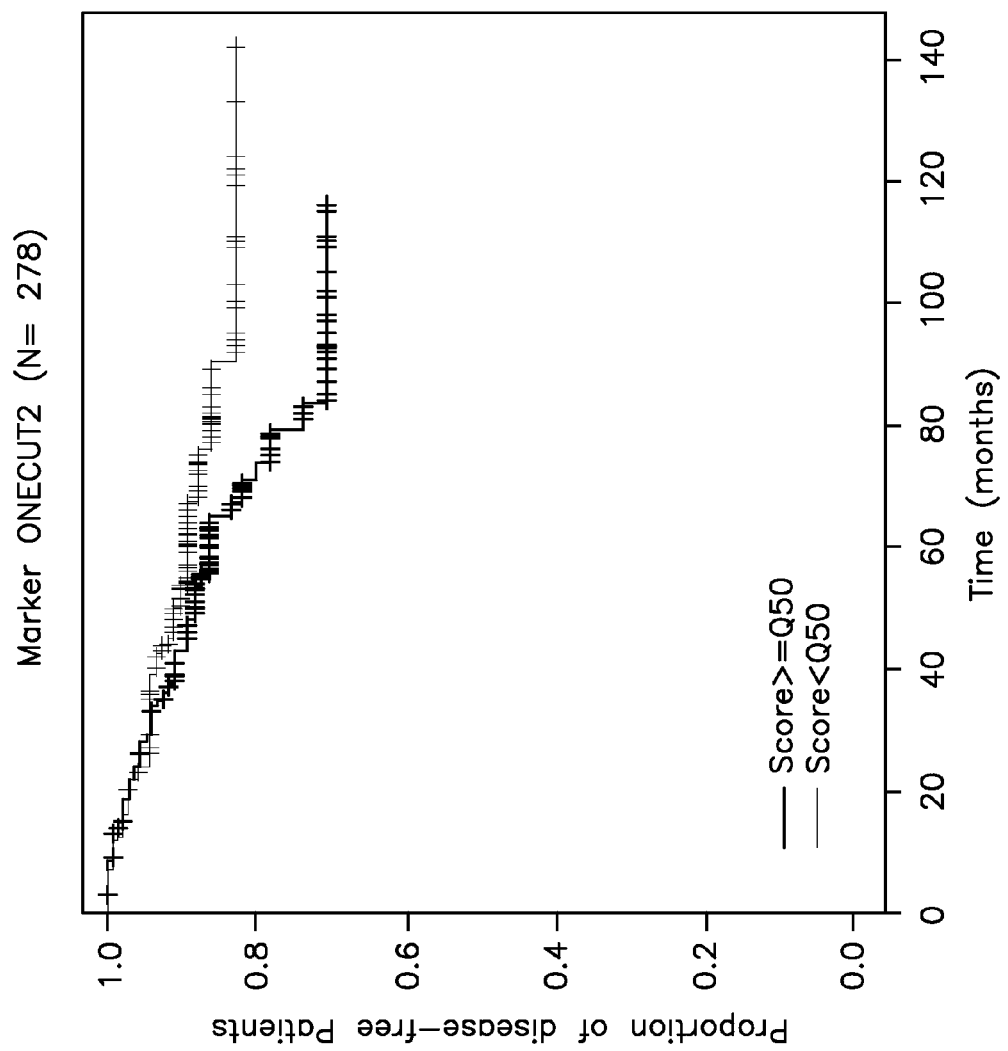
Figure 41:
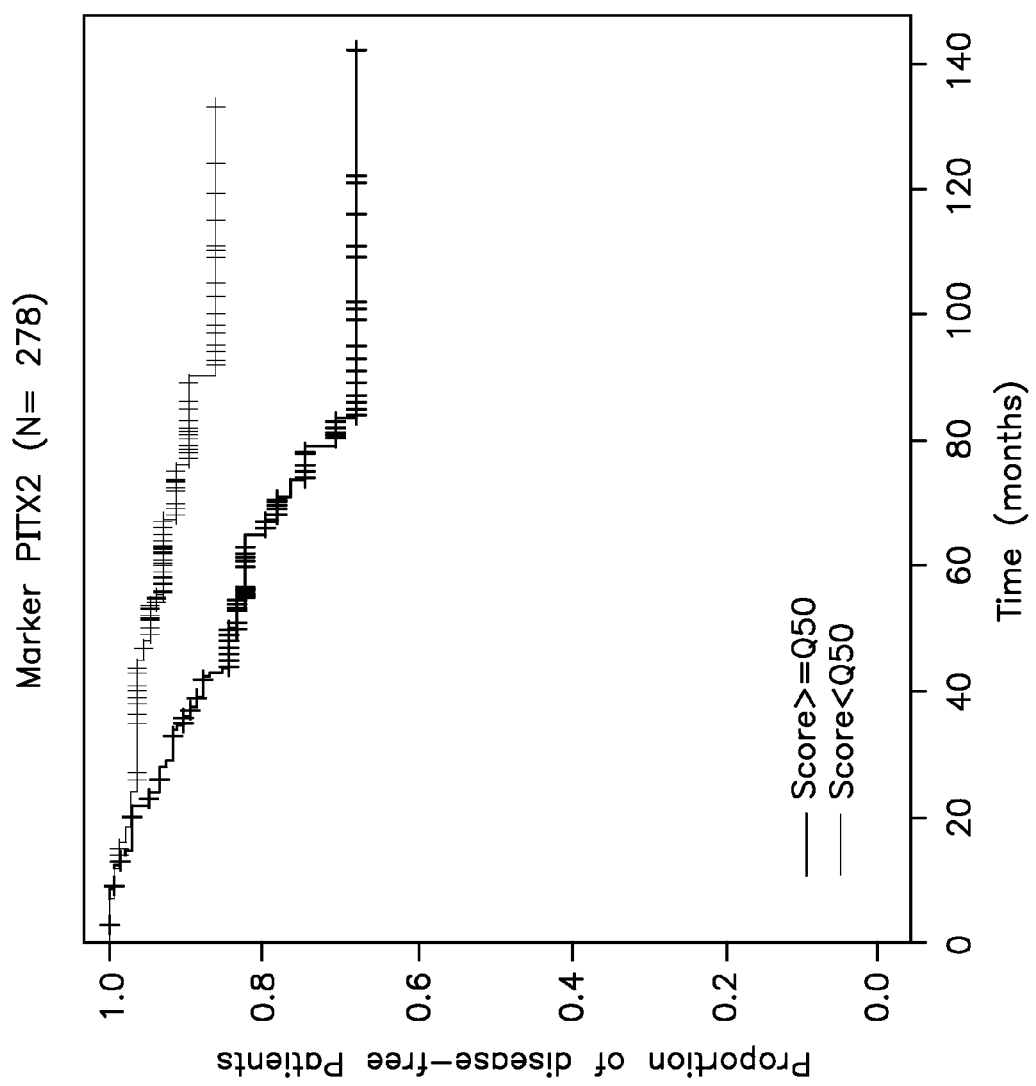
Figure 42:
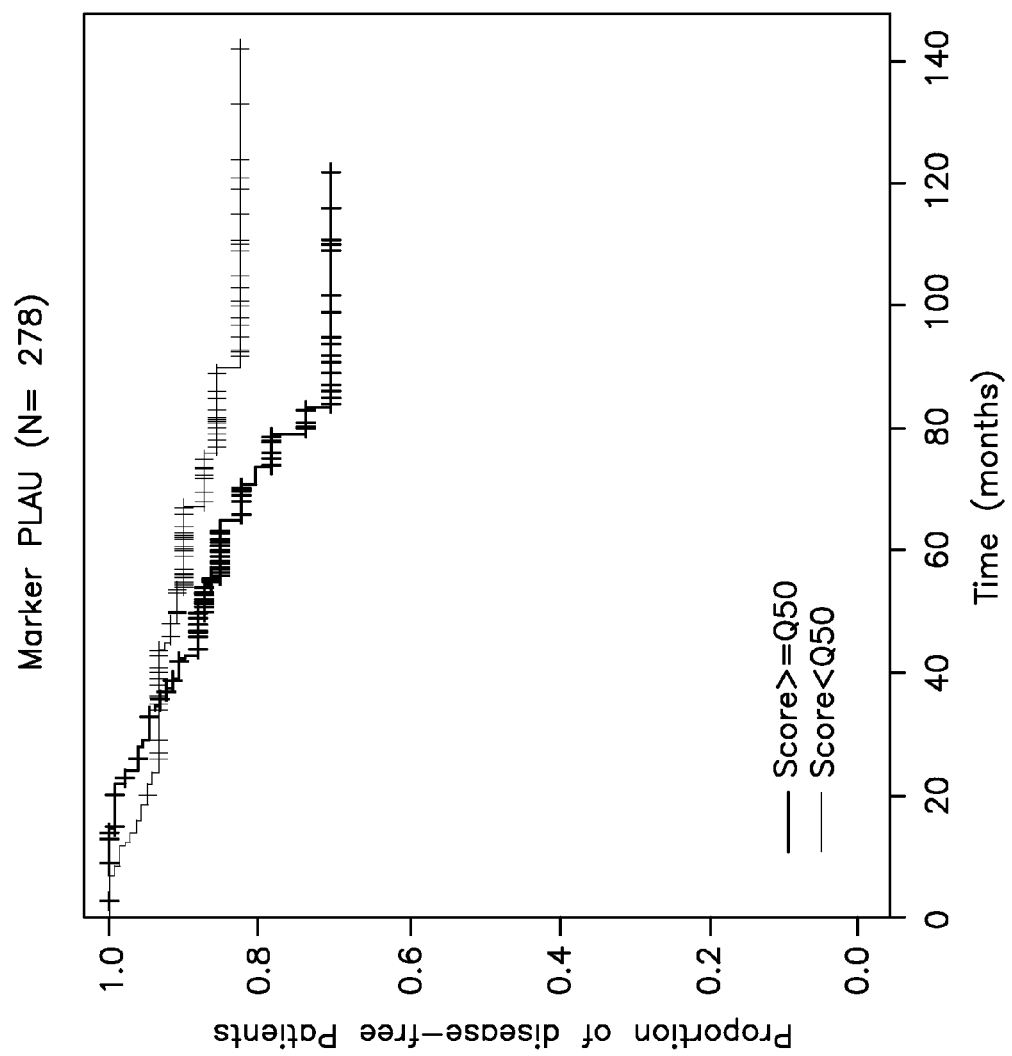
Figure 43:
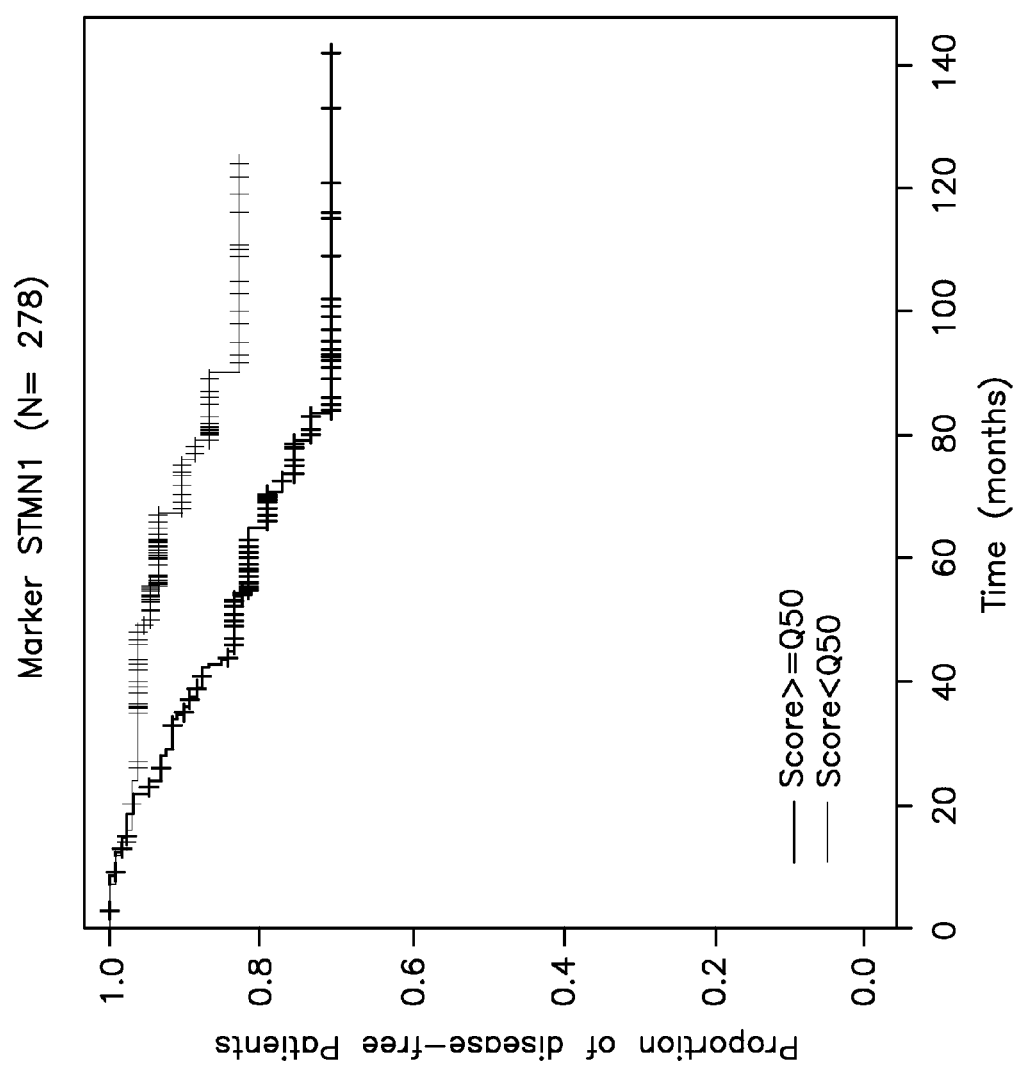
Figure 44:
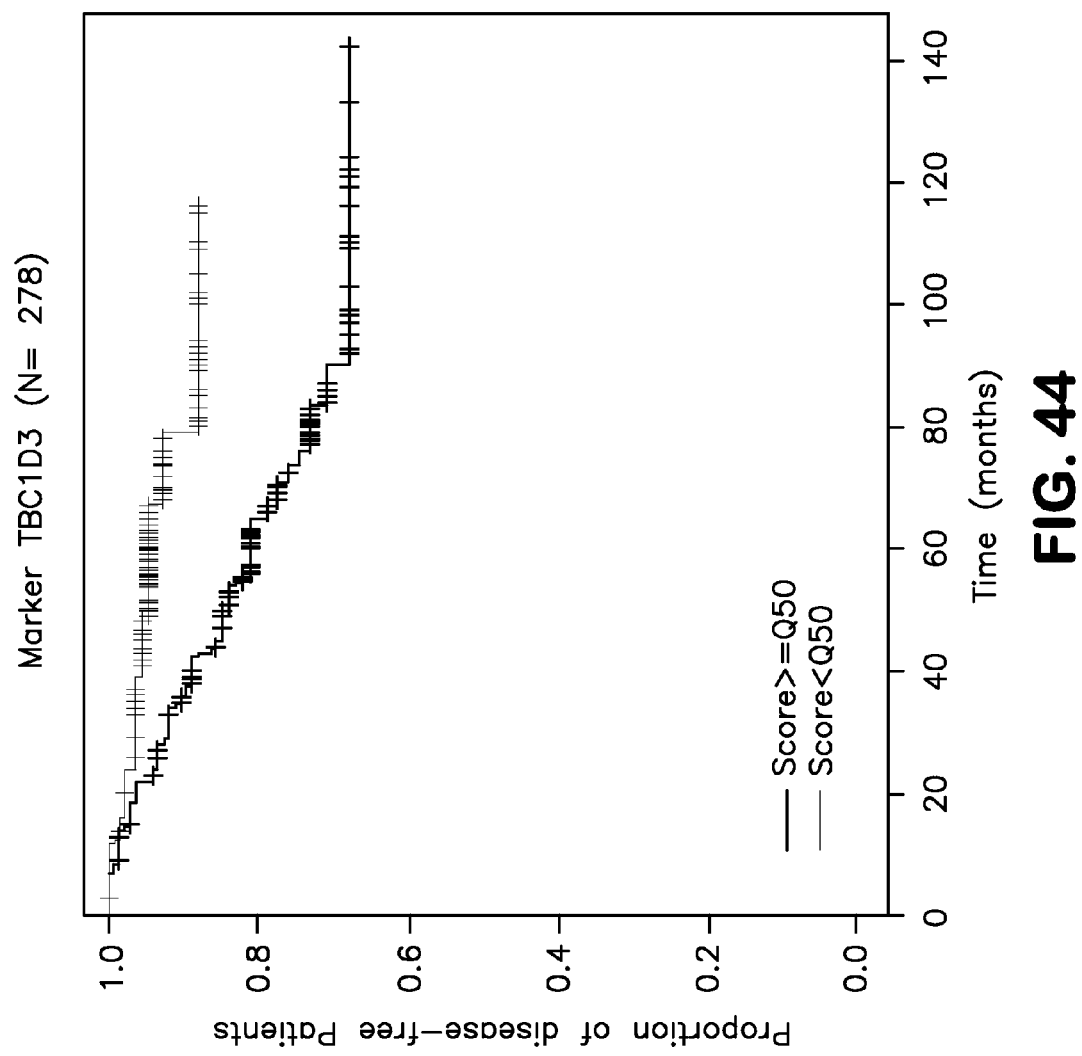
Figure 45:
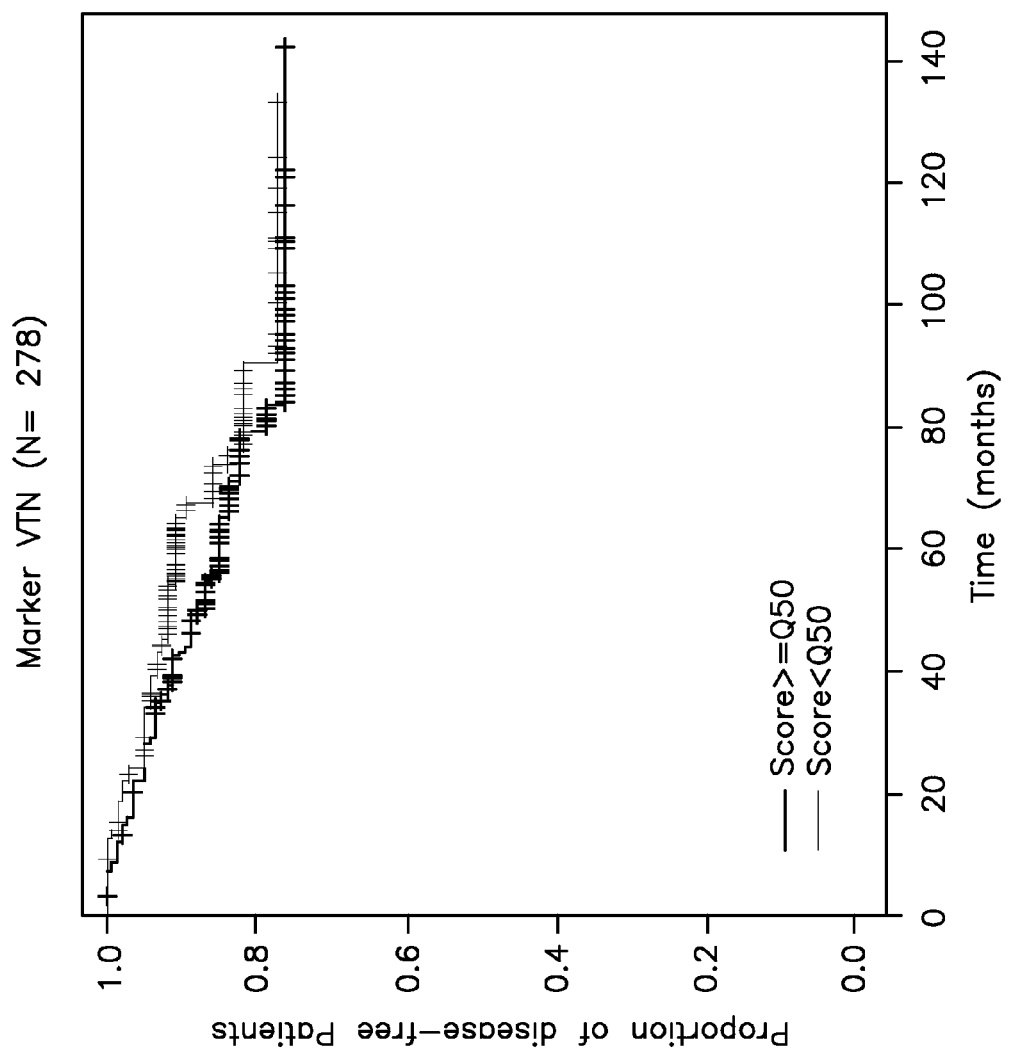
Figure 46:
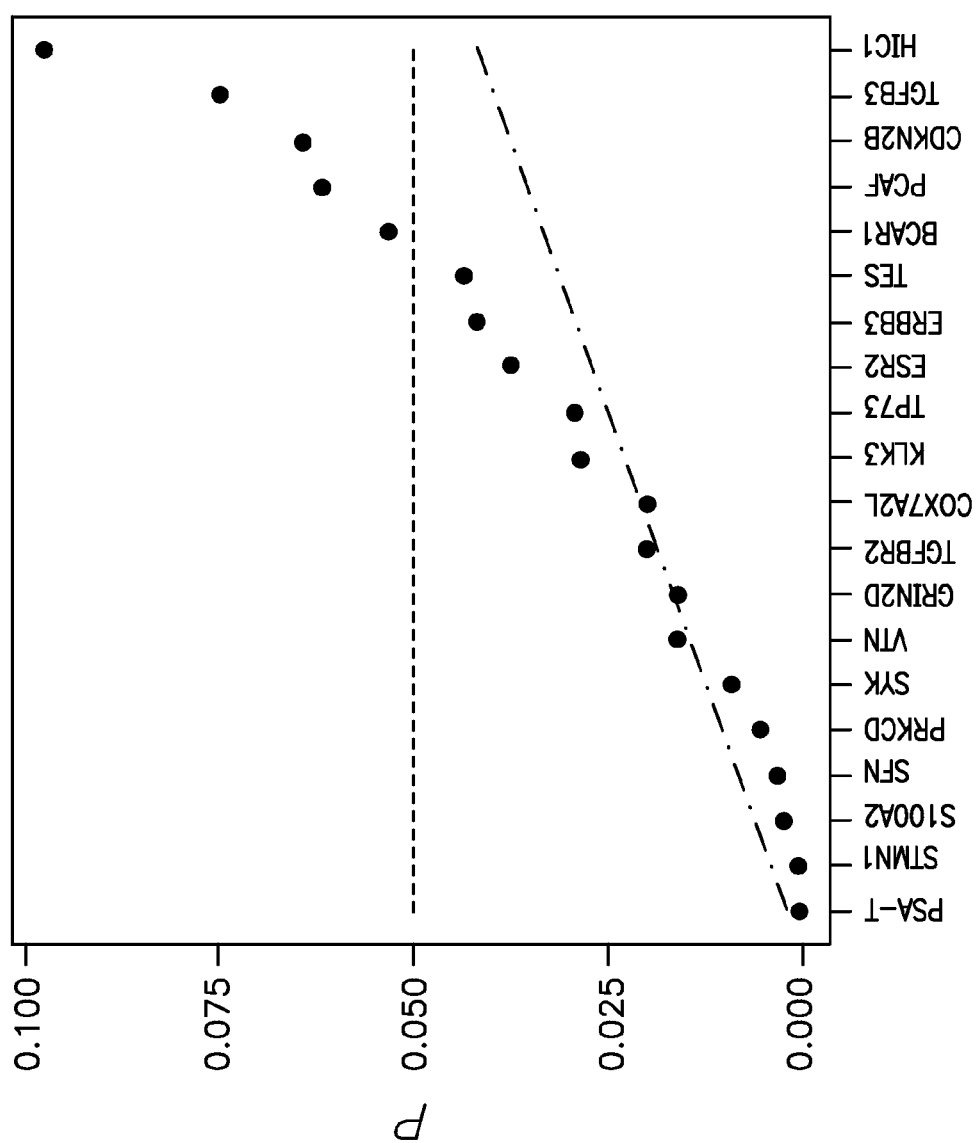
FIG. 46 shows the methylation analysis of CpG islands according to Example 1. CpG islands per gene were grouped and their correlation with objective response determined by Hotelling's $T^2$ statistics. Black dots indicate the P-value of the indicated gene. The 20 most informative genes, ranked from left to right with increasing P-value, are shown. The top dotted line marks the uncorrected significance value (P<0.05). The lower dotted line marks significance after false discovery rate correction of 25%. All genes with a P-value smaller or equal to the gene with the largest P-value that is below the lower line (in this case COX7A2L) are considered significant. The FDR correction chosen guarantees that the identified genes are with 75% chance true discoveries.

Analysis of the methylation patterns of patient samples treated with Tamoxifen in a metastatic setting (see FIG. 2) is shown in the matrices according to FIGS. 46 to 52). The subjects analysed in this classification had relapsed following an initial treatment, the subsequent metastasis being treated by Tamoxifen.

In order to determine the ability of each gene promoter to predict success or failure of Tamoxifen treatment, the individual CpGs measured were combined per gene using Hotelling's $T^2$ statistics. Several genes were significantly associated with response to tamoxifen after correcting for multiple comparison with a moderate conservative false discovery rate of 25% (see FIG. 52). The genes were ONECUT2, WBP1, CYP2D6, DAG1, ERBB2, S100A2, TFF1, TP53, TMEFF2, ESR1, SYK, RASSF1, PITX2, PSAT1, CGA and PCAF.

Figure 50:
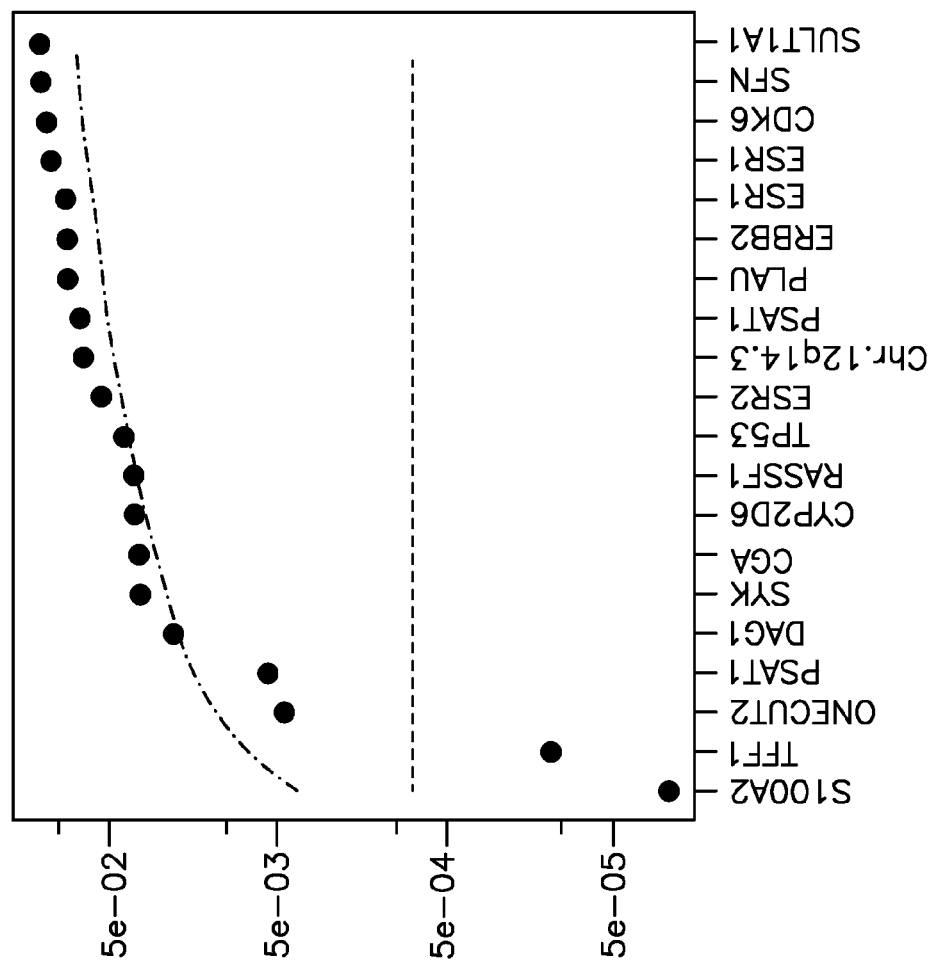

FIG. 50 shows the uncorrected p-values on a log-scale. P-values were calculated from Likelihood ratio (LR) tests from multivariate logistic regression models. Each individual genomic region of interest is represented as a point, the upper dotted line represents the cut off point for the 25% false discovery rate, the lower dotted line shows the Bonferroni corrected 5% limit.

Figure 51:
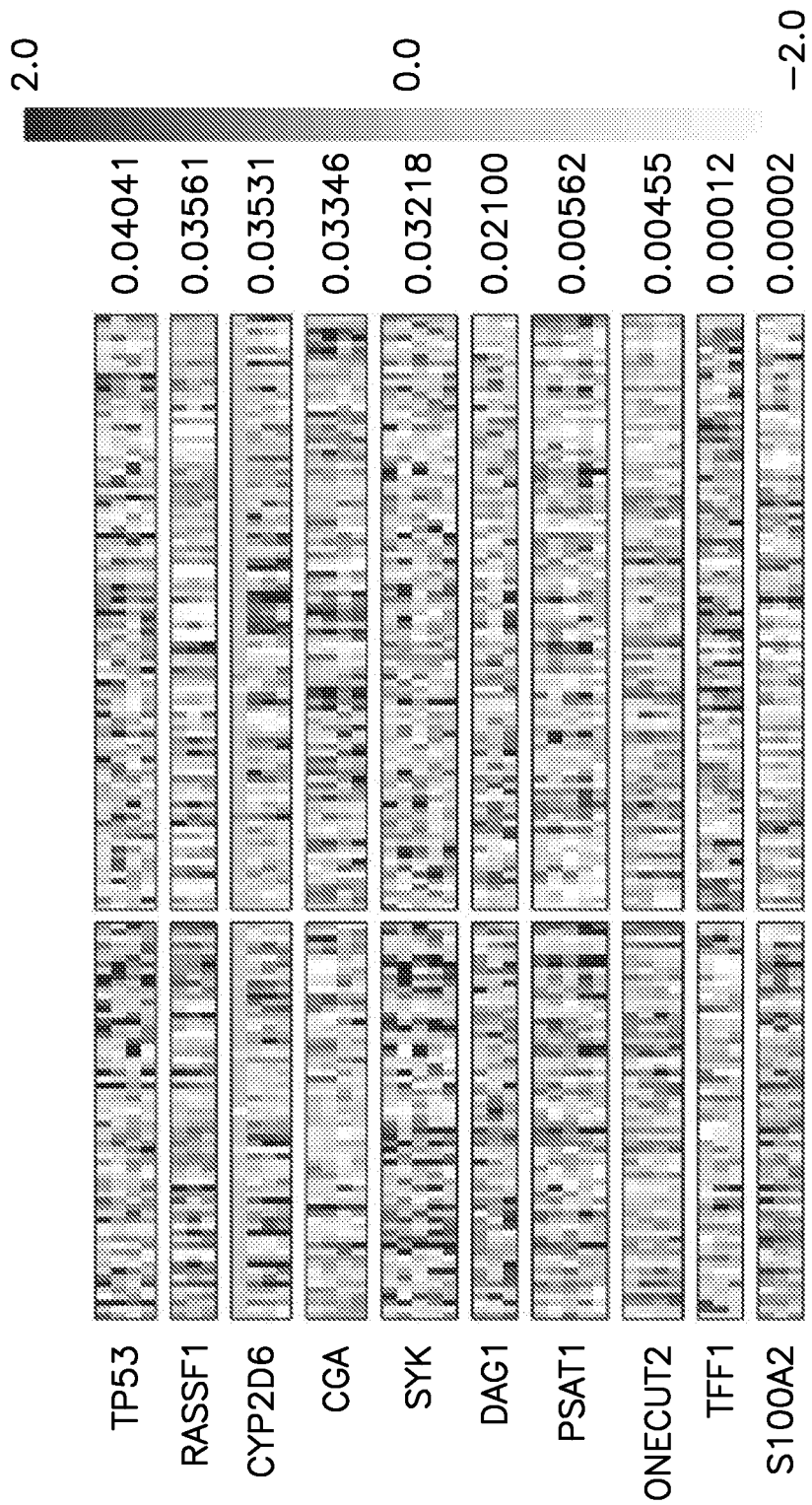
FIG. 51 shows a ranked matrix of the best 11 amplificates of data obtained according to Example 1 (Metastatic setting, all samples). P-values were calculated from Likelihood ratio (LR) tests from multivariate logistic regression models. The figure is shown in greyscale, wherein the most significant CpG positions are at the bottom of the matrix with significance decreasing towards the top. Black indicates total methylation at a given CpG position, white represents no methylation at the particular position, with degrees of methylation represented in grey, from light (low proportion of methylation) to dark (high proportion of methylation). Each row represents one specific CpG position within a gene and each column shows the methylation profile for the different CpGs for one sample. The p-values for the individual CpG positions are shown on the right side. The p-values are the probabilities that the observed distribution occurred by chance in the data set.
Figure 52:
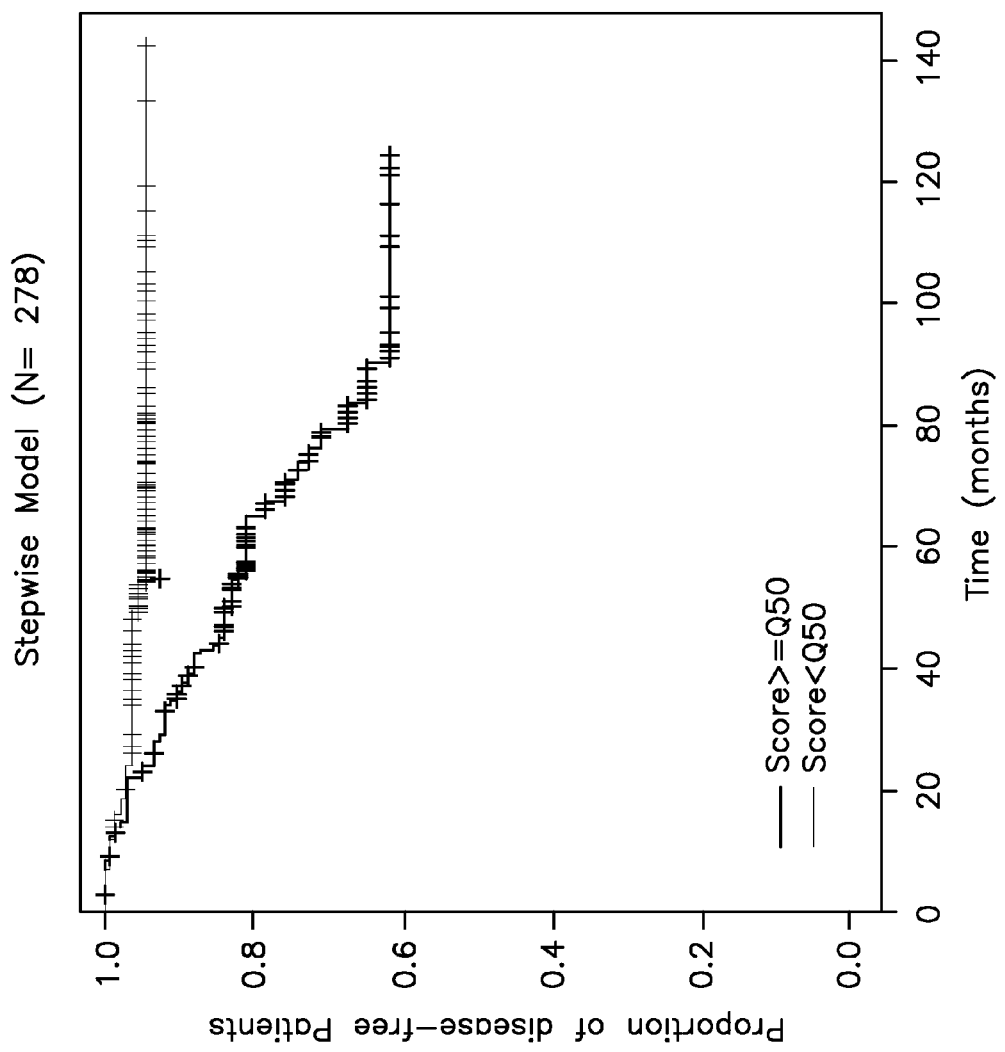
FIG. 52 shows the disease-free survival curves for a combination of two oligonucleotides each from the genes TBC1D3 and CDK6, and one oligonucleotide from the gene PITX2. The black plot shows the proportion of disease free patients in the population with above median methylation levels, the grey plot shows the proportion of disease free patients in the population with below median methylation levels.

FIG. 51 shows a ranked matrix of the best 11 amplificates of data obtained. P-values were calculated from Likelihood ratio (LR) tests from multivariate logistic regression models. The figure is shown in greyscale, wherein the most significant CpG positions are at the bottom of the matrix with significance decreasing towards the top. Black indicates total methylation at a given CpG position, white represents no methylation at the particular position, with degrees of methylation represented in grey, from light (low proportion of methylation) to dark (high proportion of methylation). Each row represents one specific CpG position within a gene and each column shows the methylation profile for the different CpGs for one sample. The p-values for the individual CpG positions are shown on the right side. The p-values are the probabilities that the observed distribution occurred by chance in the data set.

Figure 47:
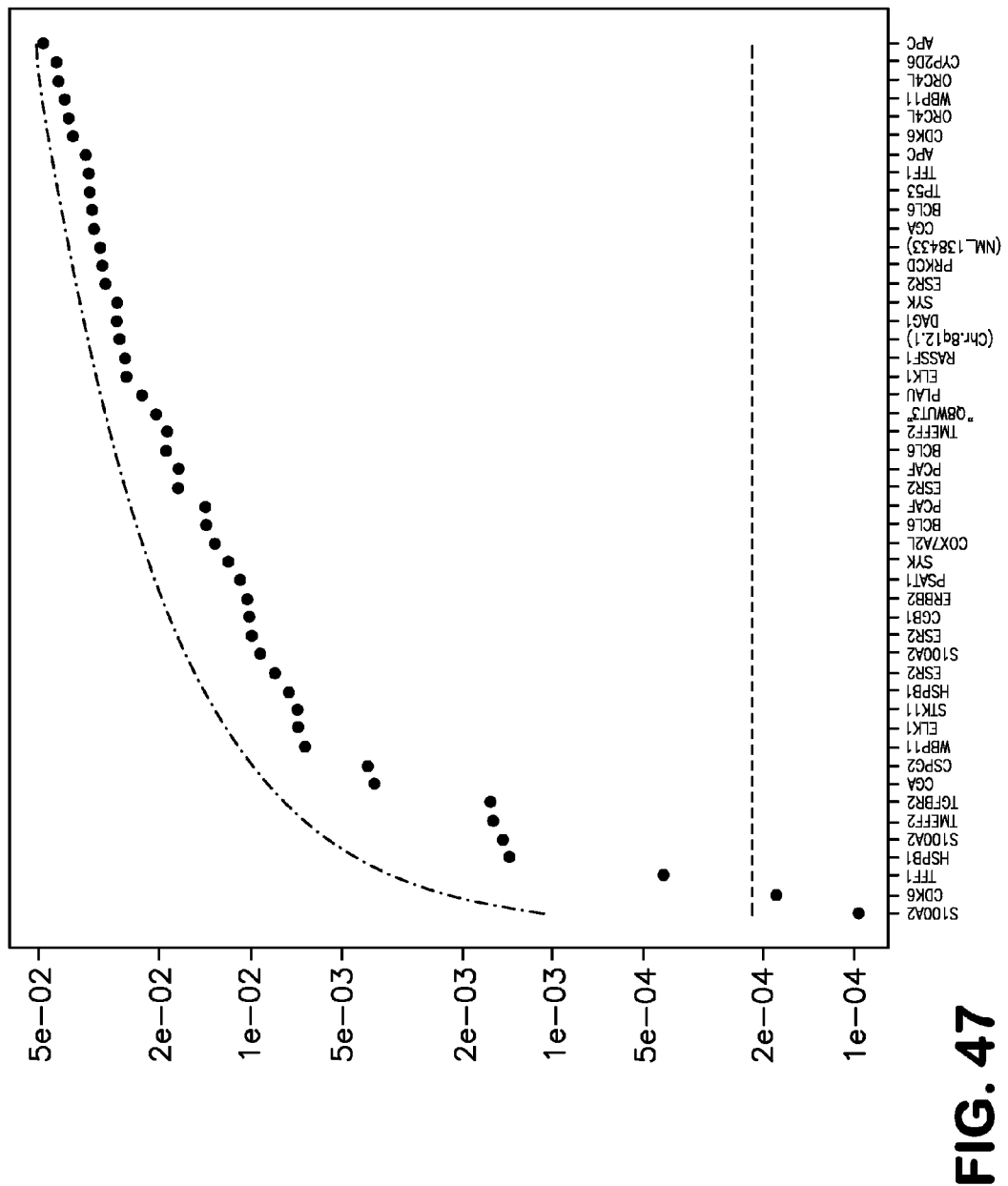
FIGS. 47 and 50 show the uncorrected p-values on a log-scale. P-values were calculated from Likelihood ratio (LR) tests from multivariate logistic regression models according to Example 1 (metastatic setting). Each individual genomic region of interest is represented as a point, the upper dotted line represents the cut off point for the 25% false discovery rate, the lower dotted line shows the Bonferroni corrected 5% limit.
Figure 48:
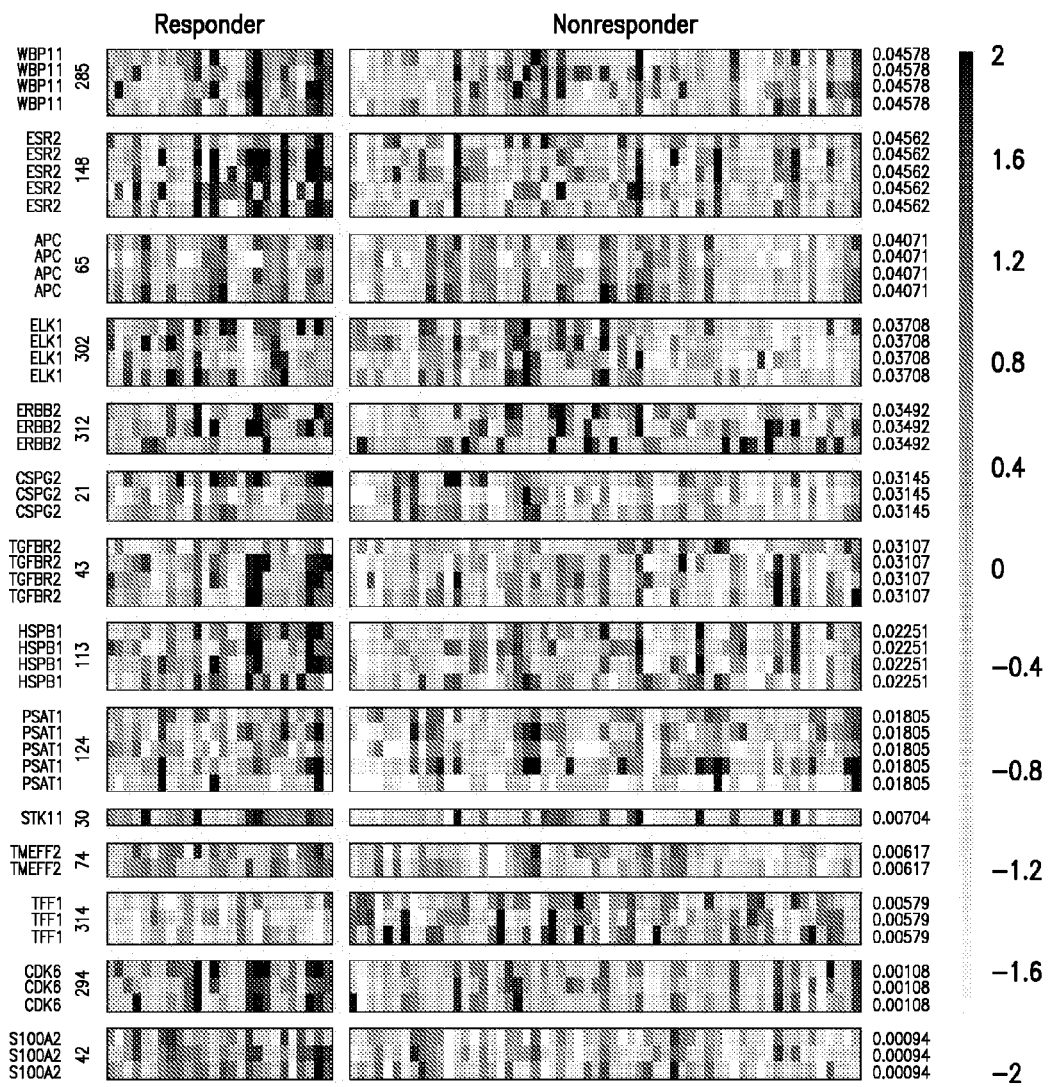
FIG. 48 shows a ranked matrix of the best 11 amplificates of data obtained according to Example 1 (Metastatic setting, limited sample set). P-values were calculated from Likelihood ratio (LR) tests from multivariate logistic regression models. The figure is shown in greyscale, wherein the most significant CpG positions are at the bottom of the matrix with significance decreasing towards the top. Black indicates total methylation at a given CpG position, white represents no methylation at the particular position, with degrees of methylation represented in grey, from light (low proportion of methylation) to dark (high proportion of methylation). Each row represents one specific CpG position within a gene and each column shows the methylation profile for the different CpGs for one sample. The p-values for the individual CpG positions are shown on the right side. The p-values are the probabilities that the observed distribution occurred by chance in the data set.
Figure 49:
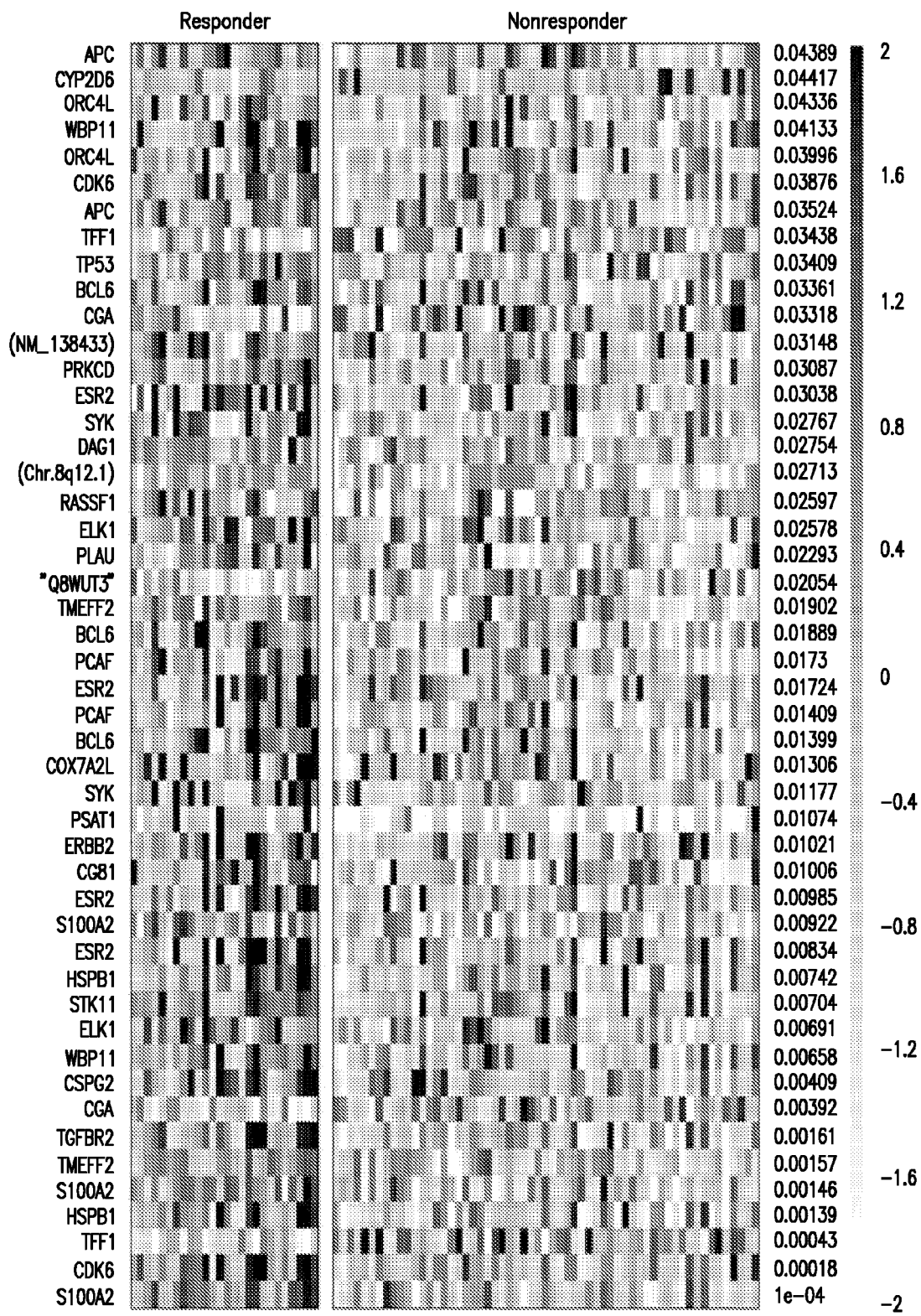
FIG. 49 shows a ranked matrix of some of the best markers obtained according to Example 1 (Metastatic setting, limited sample set). P-values were calculated from Likelihood ratio (LR) tests from univariate logistic regression models. The figure is shown in greyscale, wherein the most significant CpG positions are at the bottom of the matrix with significance decreasing towards the top. Black indicates total methylation at a given CpG position, white represents no methylation at the particular position, with degrees of methylation represented in grey, from light (low proportion of methylation) to dark (high proportion of methylation). Each row represents one specific CpG position within a gene and each column shows the methylation profile for the different CpGs for one sample. The p-values for the individual CpG positions are shown on the right side. The p-values are the probabilities that the observed distribution occurred by chance in the data set.

FIGS. 47 through 49 the analysis of a subset of shows the uncorrected p-values on a log-scale. FIG. 47 shows the uncorrected p-values on a log-scale. P-values were calculated from Likelihood ratio (LR) tests from multivariate logistic regression models according to Example 1 (metastatic setting). Each individual genomic region of interest is represented as a point, the upper dotted line represents the cut off point for the 25% false discovery rate, the lower dotted line shows the Bonferroni corrected 5% limit.

FIG. 48 shows a ranked matrix of the best 11 amplificates of data obtained. P-values were calculated from Likelihood ratio (LR) tests from multivariate logistic regression models. The figure is shown in greyscale, wherein the most significant CpG positions are at the bottom of the matrix with significance decreasing towards the top. Black indicates total methylation at a given CpG position, white represents no methylation at the particular position, with degrees of methylation represented in grey, from light (low proportion of methylation) to dark (high proportion of methylation). Each row represents one specific CpG position within a gene and each column shows the methylation profile for the different CpGs for one sample. The p-values for the individual CpG positions are shown on the right side. The p-values are the probabilities that the observed distribution occurred by chance in the data set.

Real time Quantitative Methylation Analysis

Genomic DNA was analyzed using the Real Time PCR technique after bisulfite conversion In this analysis four oligonucleotides were used in each reaction. Two non methylation specific PCR primers were used to amplify a segment of the treated genomic DNA containing a methylation variable oligonucleotide probe binding site. Two oligonucleotide probes competitively hybridise to the binding site, one specific for the methylated version of the binding site, the other specific to the unmethylated version of the binding site. Accordingly, one of the probes comprises a CpG at the methylation variable position (i.e. anneals to methylated bisulphite treated sites) and the other comprises a TpG at said position (i.e. anneals to unmethylated bisulphite treated sites). Each species of probe is labelled with a 5' fluorescent reporter dye and a 3' quencher dye wherein the CpG and TpG oligonucleotides are labelled with different dyes.

The reactions are calibrated by reference to DNA standards of known methylation levels in order to quantify the levels of methylation within the sample. The DNA standards were composed of bisulfite treated phi29 amplified genomic DNA (i.e. unmethylated), and/or phi29 amplified genomic DNA treated with Sss1 Methylase enzyme (thereby methylating each CpG position in the sample), which is then treated with bisulfite solution. Seven different reference standards were used with 0%, (i.e. phi29 amplified genomic DNA only), 5%, 10%, 25%, 50%, 75% and 100% (i.e. phi29 Sss1 treated genomic only).

The amount of sample DNA amplified is quantified by reference to the gene ($\beta$-actin (ACTB)) to normalize for input DNA. For standardization the primers and the probe for analysis of the ACTB gene lack CpG dinucleotides so that amplification is possible regardless of methylation levels. As there are no methylation variable positions, only one probe oligonucleotide is required.

The following oligonucleotides were used in the reaction:

```
Primer:
                                    (SEQ ID NO: 1088)
TGGTGATGGAGGAGGTTTAGTAAGT Primer:
                                    (SEQ ID NO: 1089)
AACCAATAAAACCTACTCCTCCCTTAA Probe:
                                    (SEQ ID NO: 1090)
6FAM-ACCACCACCCAACACACAATAACAAACACA-TAMRA or
Dabcyl
```

The extent of methylation at a specific locus was determined by the following formula:

$$\text{methylation rate} = 100 * I_{CG}/(I_{CG}+I_{TG})$$

($I$=Intensity of the fluorescence of $CG$-probe or $TG$-probe)

Gene PITX2

```
Primers:
PITX2R02:
GTAGGGGAGGGAAGTAGATGTT          (SEQ ID NO: 1091)

PITX2Q02:
TTCTAATCCTCCTTTCCACAATAA        (SEQ ID NO: 1092)
```

Amplificate length: 143 bp

```
Probes:
PITX2cg1:
                                    (SEQ ID NO: 1093)
FAM-AGTCGGAGTCGGGAGAGCGA-Darquencher PITX2tg1:
                                    (SEQ ID NO: 1094)
YAKIMA YELLOW-AGTTGGAGTTGGGAGAGTGAAAGGAGA-
Darquencher
```

PCR components: 3 mM MgCl2 buffer, 10× buffer, Hotstart TAQ

Program (45 cycles): 95° C., 10 min; 95° C., 15 sec; 62° C., 1 min

Figure 54:
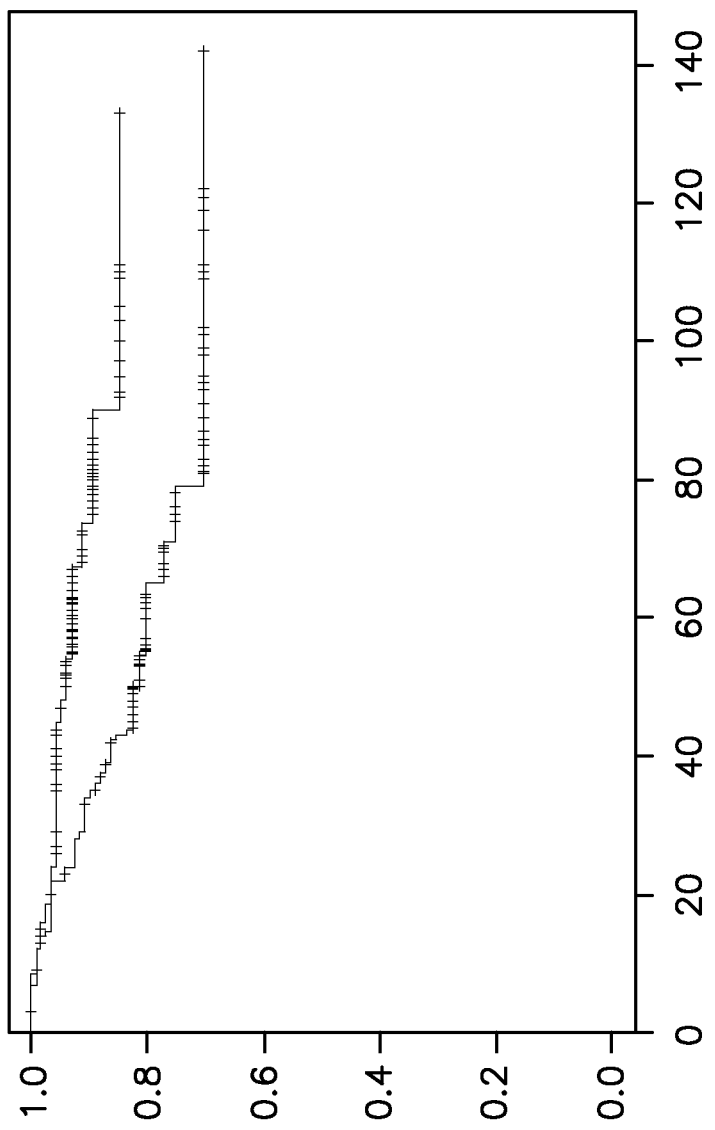
FIG. 54 shows the Kaplan-Meier estimated disease-free survival curves for a CpG position of the PITX2 gene by means of Real-Time methylation specific probe analysis. The lower plot shows the proportion of disease free patients in the population with above median methylation levels, the upper plot shows the proportion of disease free patients in the population with below median methylation levels. The X axis shows the disease free survival times of the patients in months, and the Y-axis shows the proportion of disease free survival patients.
Figure 55:
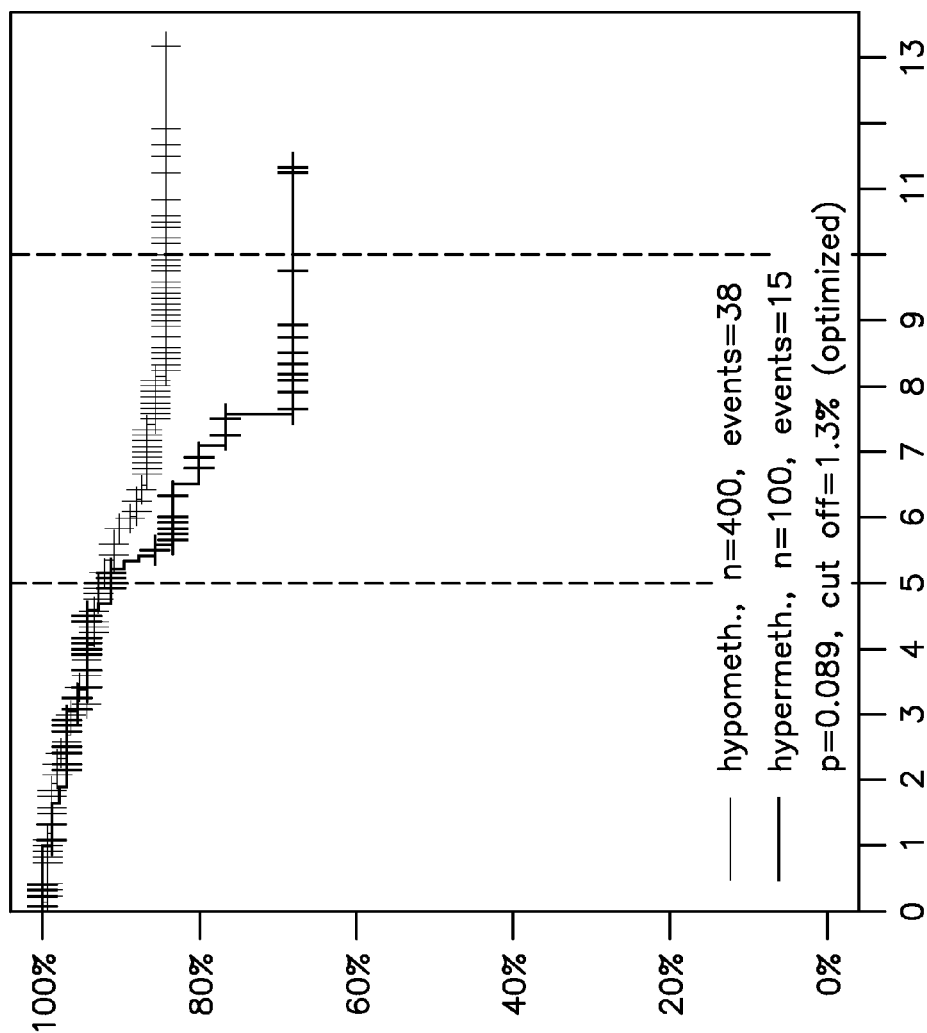
FIG. 55 shows the Kaplan-Meier estimated disease-free survival curves for a CpG position of the ERBB2 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 56:
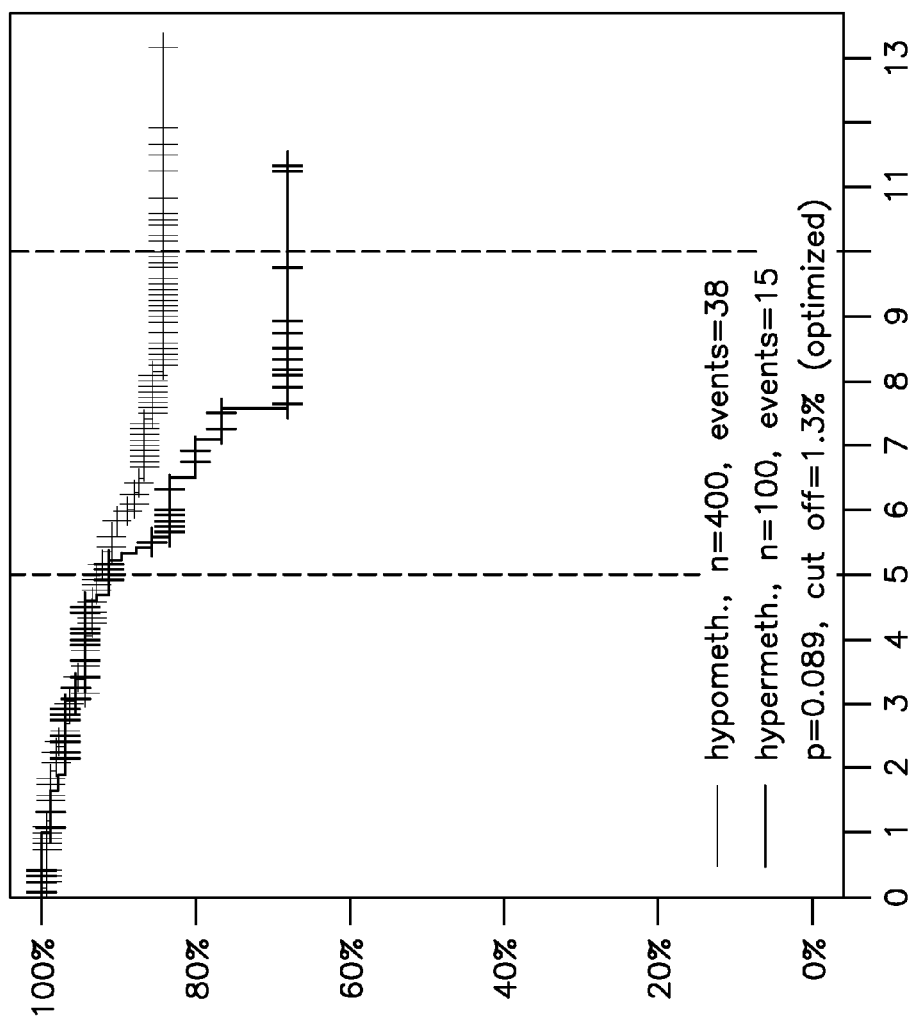
FIG. 56 shows the Kaplan-Meier estimated metastasis-free survival curves for a CpG position of the ERBB2 gene by means of Real-Time methylation specific probe analysis according to Example 2. The X axis shows the disease free survival times of the patients in years, and the Y-axis shows the proportion of patients with disease free survival. The black plot shows the proportion of metastasis free patients in the population with above an optimised cut off point's methylation levels, the grey plot shows the proportion of disease free patients in the population with below an optimised cut off point's methylation levels.
Figure 57:
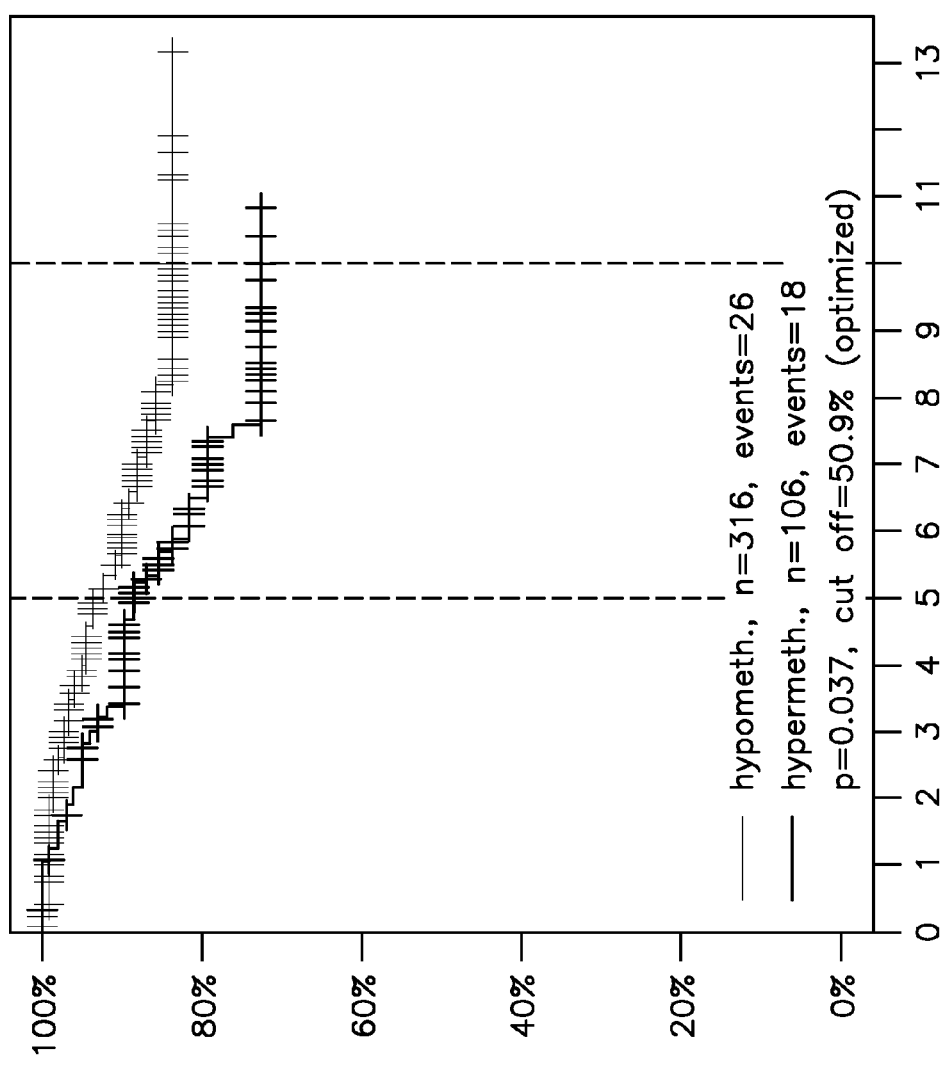
FIG. 57 shows the Kaplan-Meier estimated disease-free survival curves for a CpG position of the TFF1 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 58:
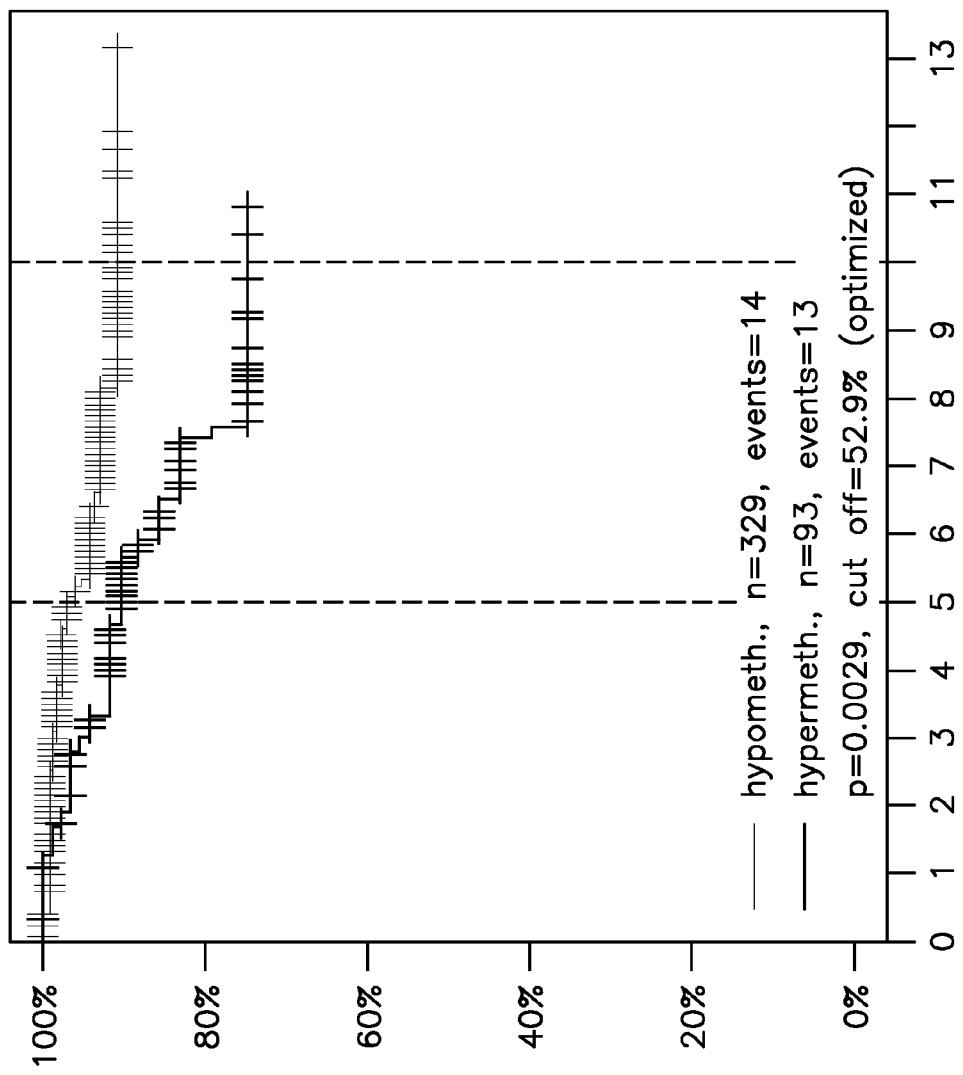
FIG. 58 shows the Kaplan-Meier estimated metastasis-free survival curves for a CpG position of the TFF1 gene by means of Real-Time methylation specific probe analysis according to Example 2. The X axis shows the disease free survival times of the patients in years, and the Y-axis shows the proportion of patients with disease free survival. The black plot shows the proportion of metastasis free patients in the population with above an optimised cut off point's methylation levels, the grey plot shows the proportion of metastasis free patients in the population with below an optimised cut off point's methylation levels.
Figure 59:
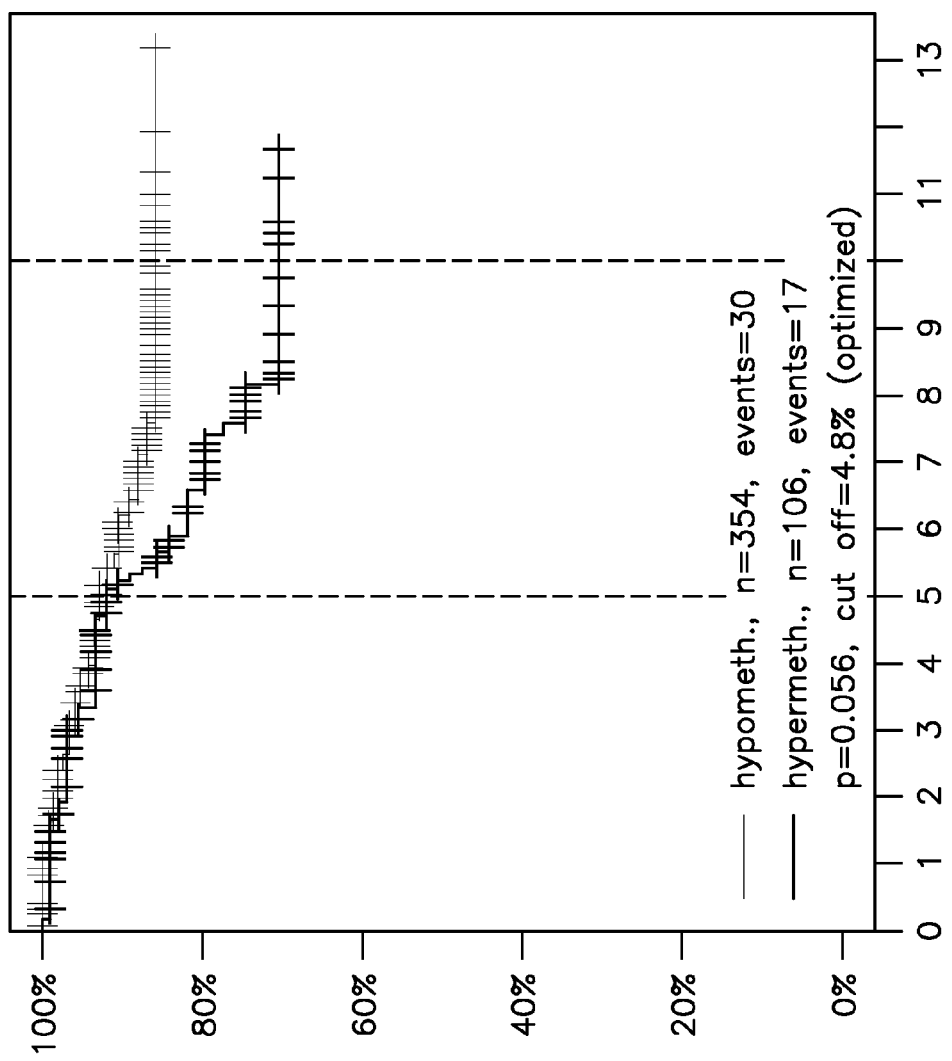
FIG. 59 shows the Kaplan-Meier estimated disease-free survival curves for a CpG position of the PLAU gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 60:
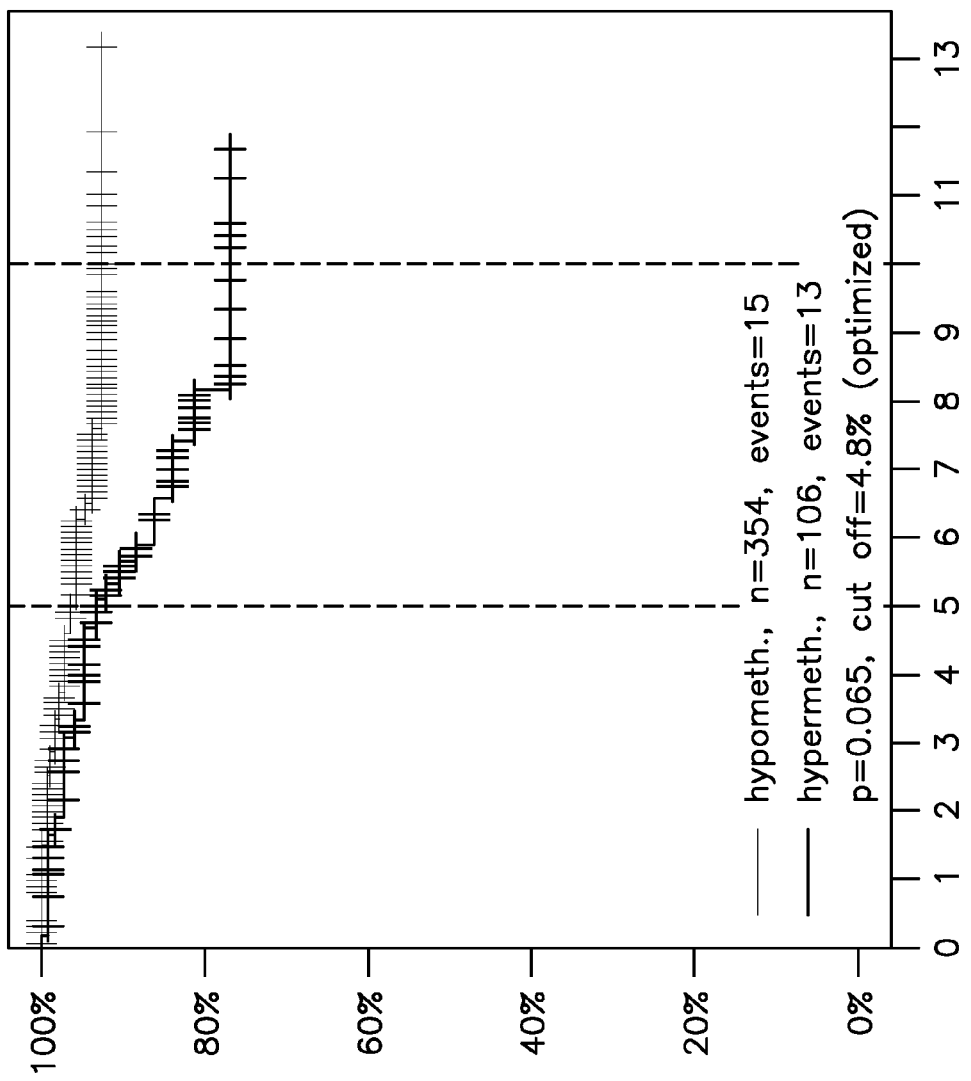
FIG. 60 shows the Kaplan-Meier estimated metastasis-free survival curves for a CpG position of the PLAU gene by means of Real-Time methylation specific probe analysis according to Example 2. The X axis shows the disease free survival times of the patients in years, and the Y-axis shows the proportion of patients with metastasis free survival. The black plot shows the proportion of disease free patients in the population with above an optimised cut off point's methylation levels, the grey plot shows the proportion of metastasis free patients in the population with below an optimised cut off point's methylation levels.
Figure 61:
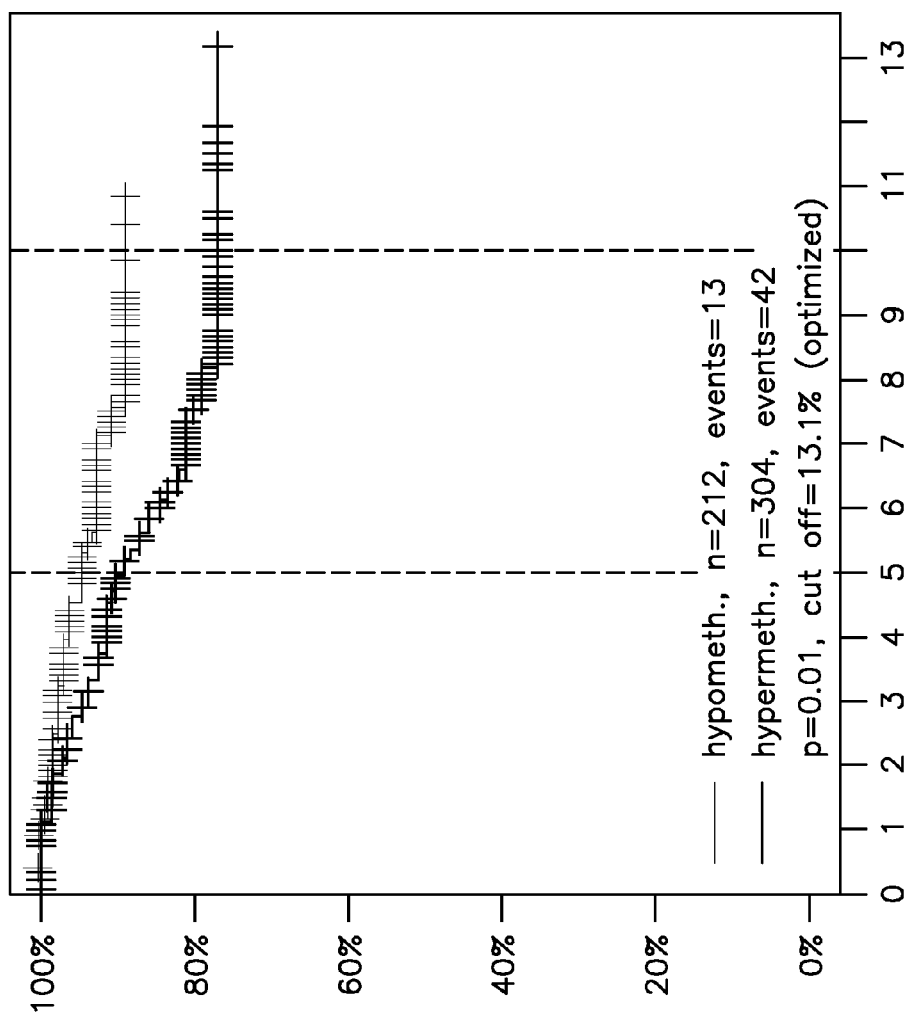
FIG. 61 shows the Kaplan-Meier estimated disease-free survival curves for a CpG position of the PITX2 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 62:
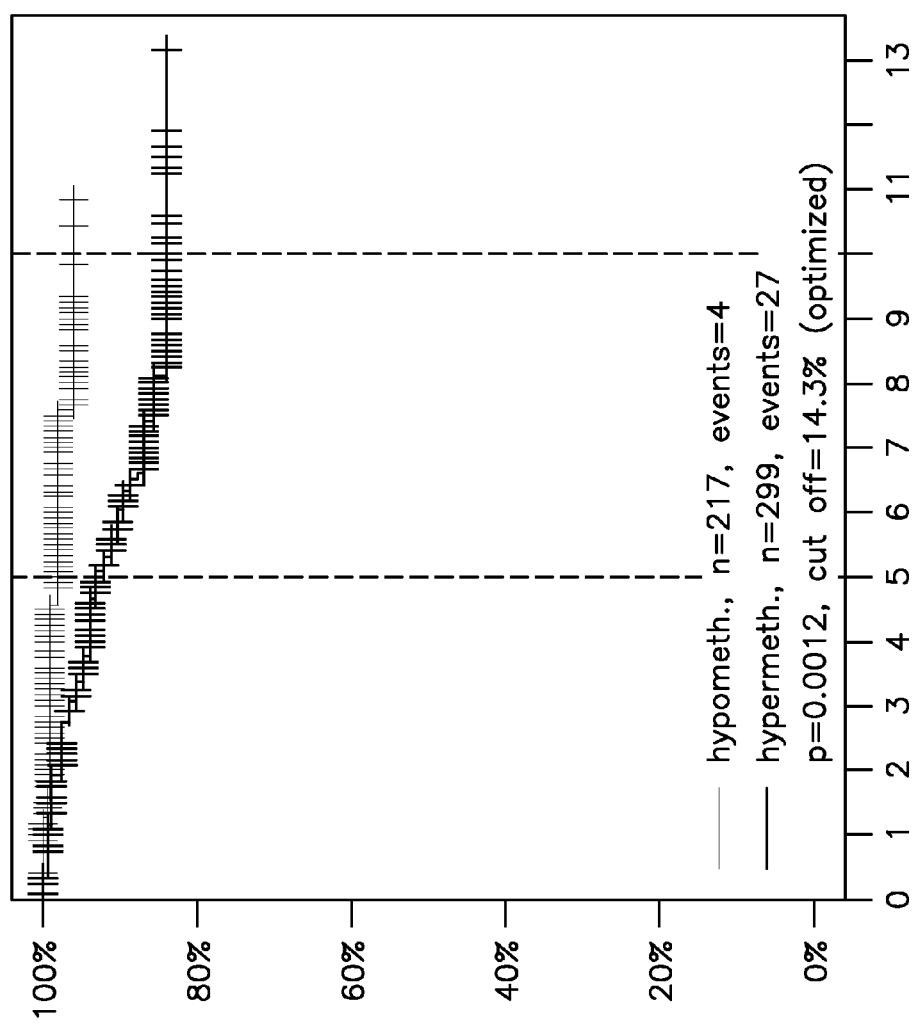
FIG. 62 shows the Kaplan-Meier estimated metastasis-free survival curves for a CpG position of the PITX2 gene by means of Real-Time methylation specific probe analysis according to Example 2. The X axis shows the disease free survival times of the patients in years, and the Y-axis shows the proportion of patients with metastasis free survival. The black plot shows the proportion of metastasis free patients in the population with above an optimised cut off point's methylation levels, the grey plot shows the proportion of disease free patients in the population with below an optimised cut off point's methylation levels.
Figure 63:
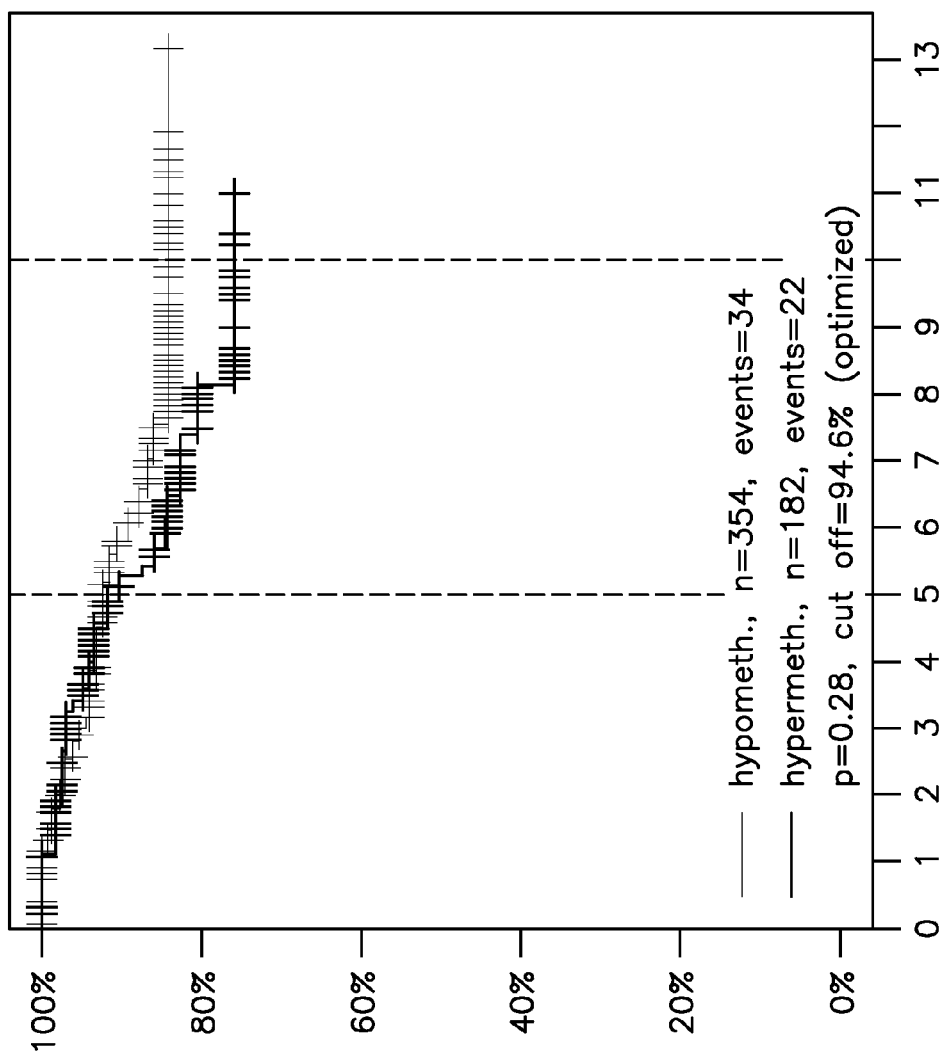
FIG. 63 shows the Kaplan-Meier estimated disease-free survival curves for a CpG position of the TBC1D3 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 64:
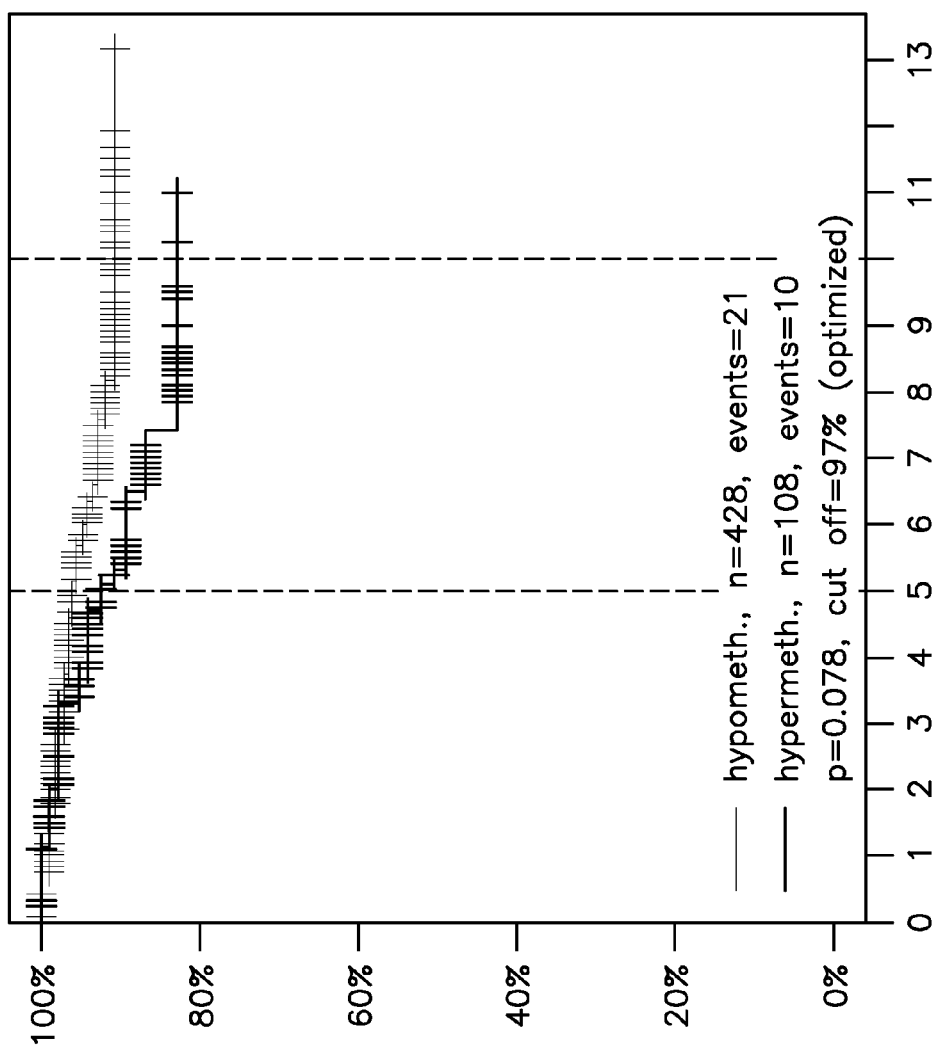
FIG. 64 shows the Kaplan-Meier estimated metastasis-free survival curves for a CpG position of the TBC1D3 gene by means of Real-Time methylation specific probe analysis according to Example 2. The X axis shows the disease free survival times of the patients in years, and the Y-axis shows the proportion of patients with metastasis free survival. The black plot shows the proportion of metastasis free patients in the population with above an optimised cut off point's methylation levels, the grey plot shows the proportion of disease free patients in the population with below an optimised cut off point's methylation levels.
Figure 65:
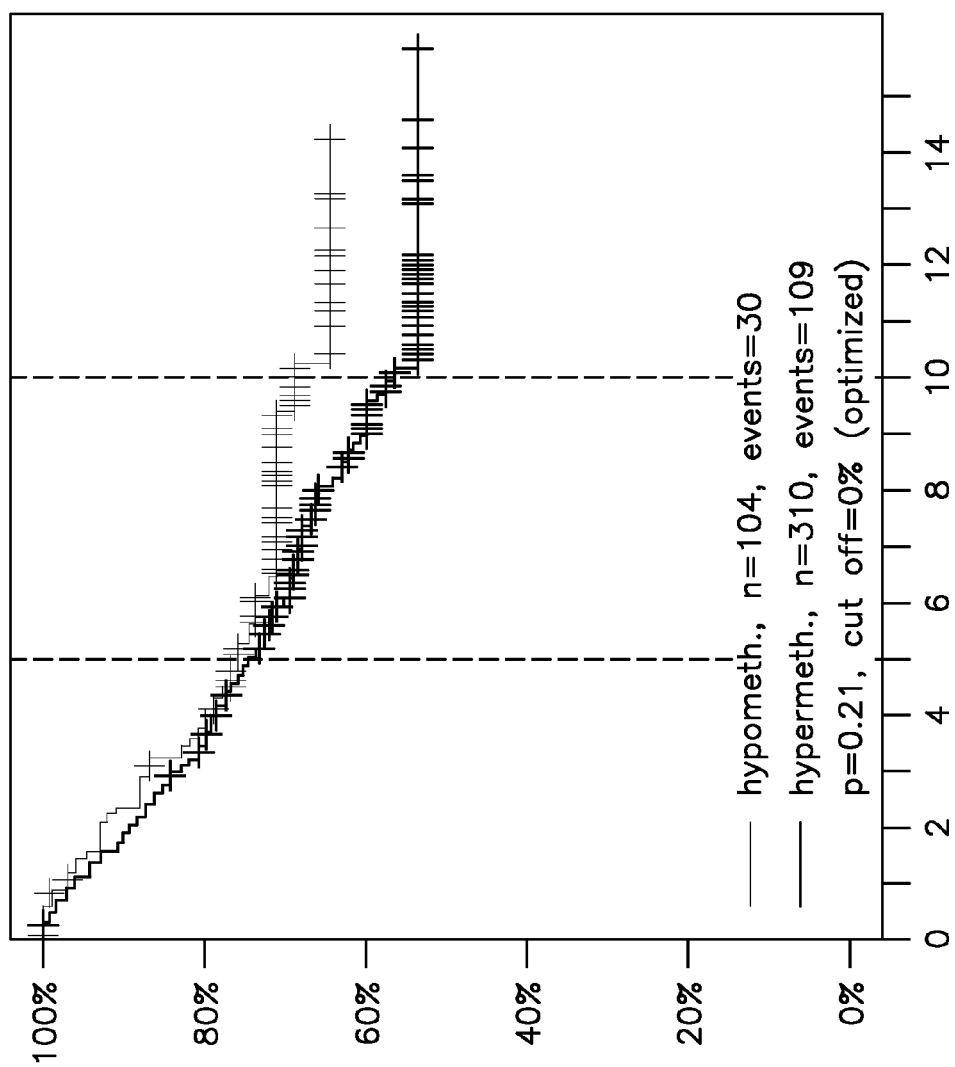
FIG. 65 shows the Kaplan-Meier estimated disease-free survival curves for a CpG position of the ERBB2 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 66:
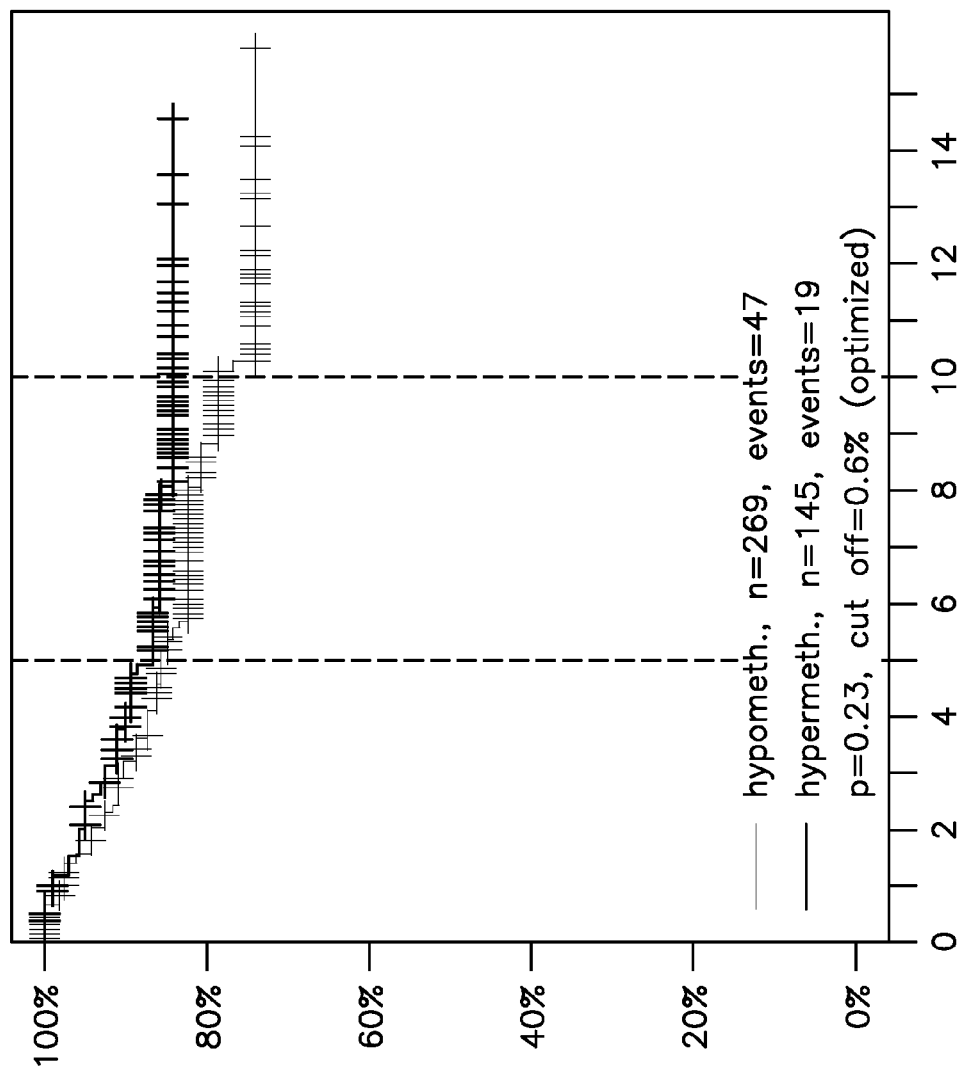
FIG. 66 shows the Kaplan-Meier estimated metastasis-free survival curves for a CpG position of the ERBB2 gene by means of Real-Time methylation specific probe analysis according to Example 2. The X axis shows the disease free survival times of the patients in years, and the Y-axis shows the proportion of patients with metastasis free survival. The black plot shows the proportion of metastasis free patients in the population with above an optimised cut off point's methylation levels, the grey plot shows the proportion of disease free patients in the population with below an optimised cut off point's methylation levels.
Figure 67:
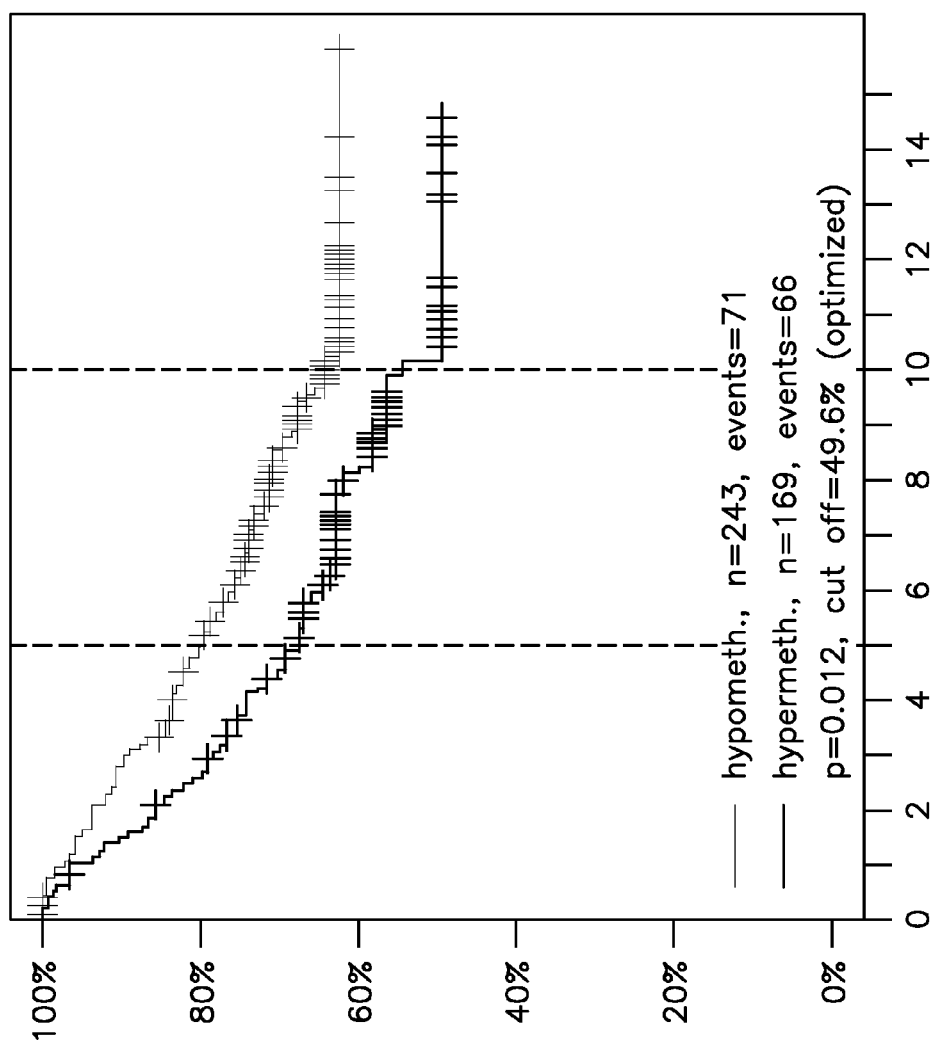
FIG. 67 shows the Kaplan-Meier estimated disease-free survival curves for a CpG position of the TFF1 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 68:
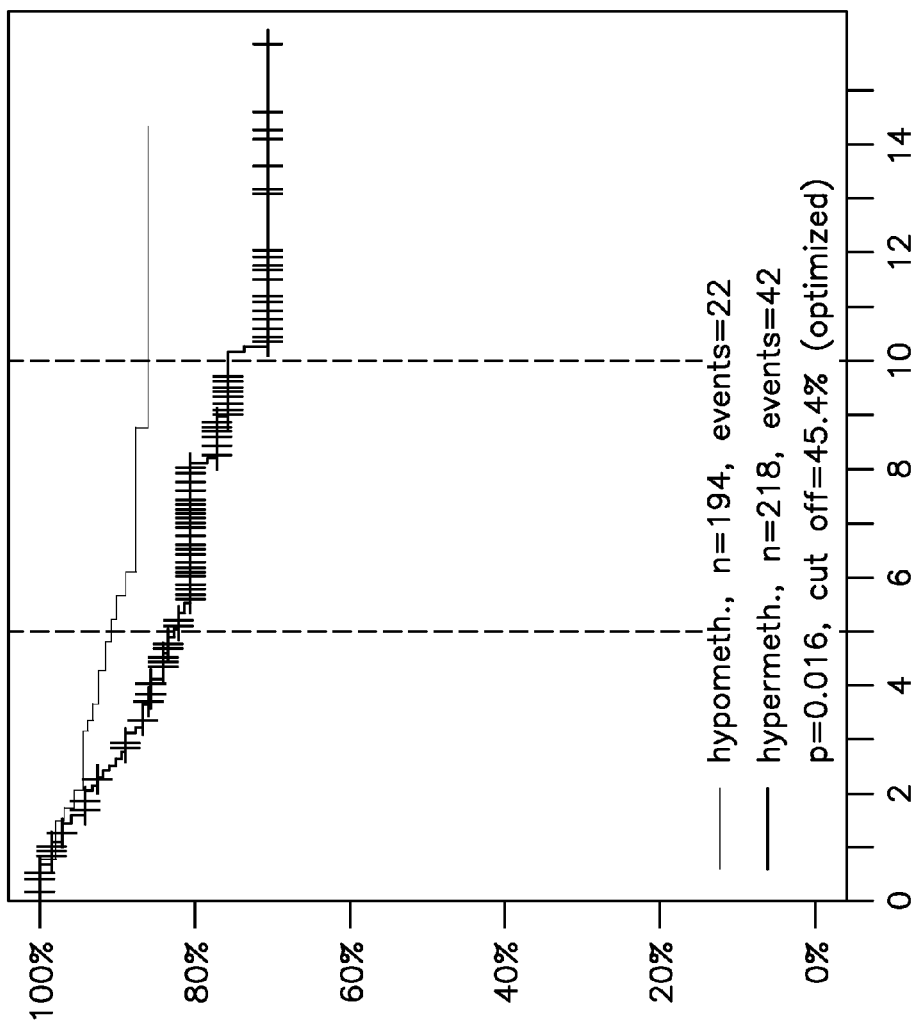
FIG. 68 shows the Kaplan-Meier estimated metastasis-free survival curves for a CpG position of the TFF1 gene by means of Real-Time methylation specific probe analysis according to Example 2. The X axis shows the disease free survival times of the patients in years, and the Y-axis shows the proportion of patients with disease free survival. The black plot shows the proportion of metastasis free patients in the population with above an optimised cut off point's methylation levels, the grey plot shows the proportion of metastasis free patients in the population with below an optimised cut off point's methylation levels.
Figure 69:
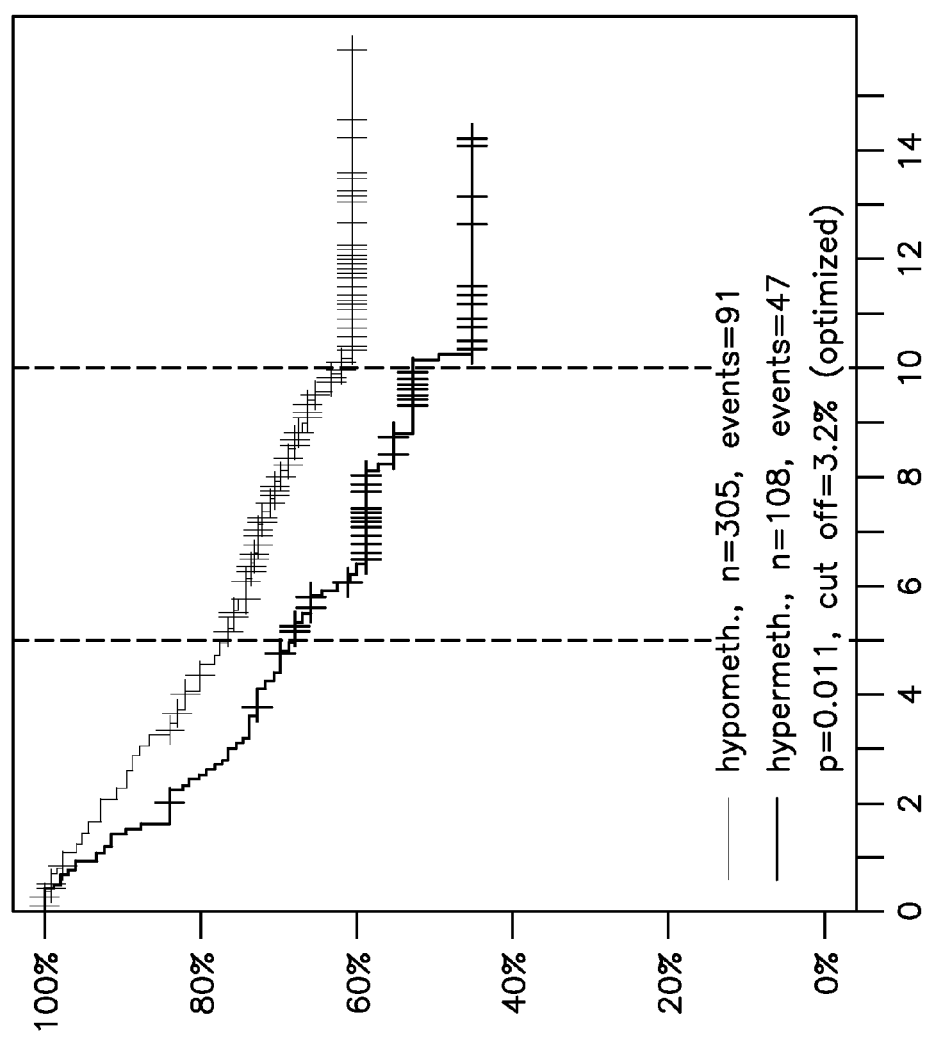
FIG. 69 shows the Kaplan-Meier estimated disease-free survival curves for a CpG position of the PLAU gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 70:
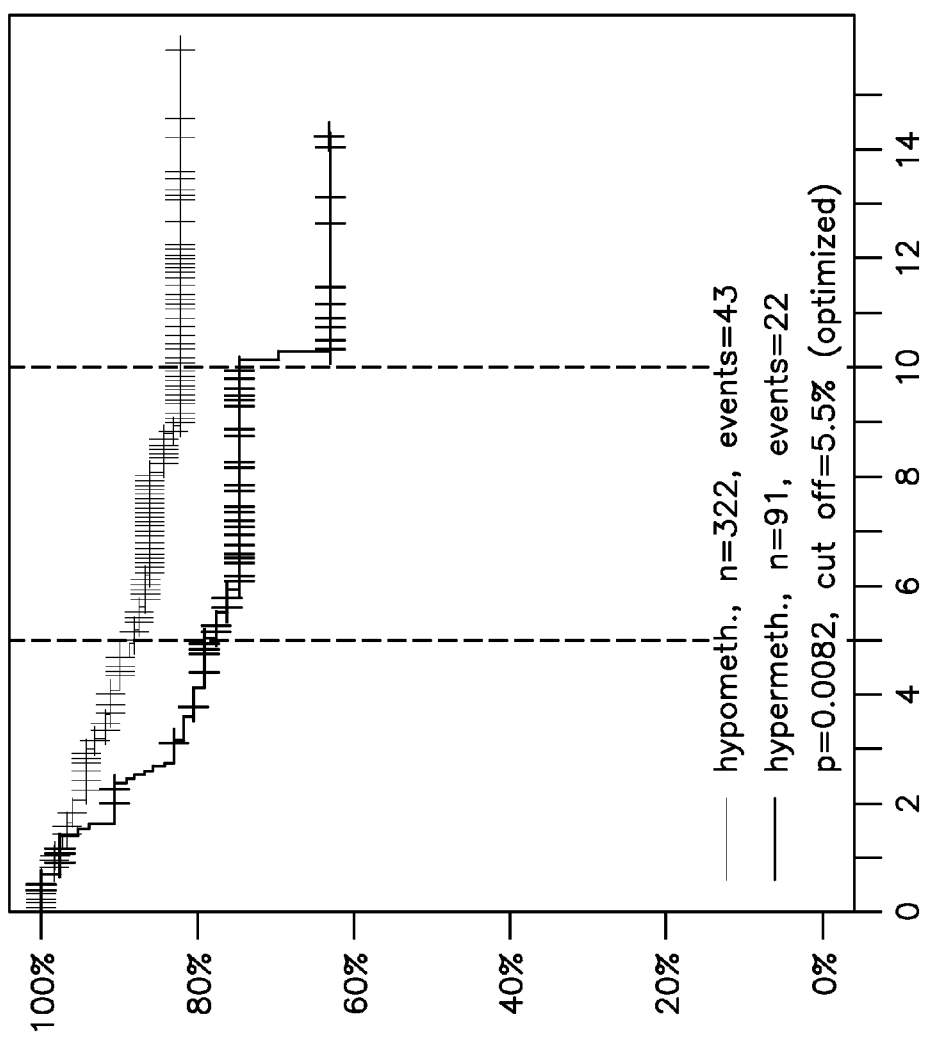
FIG. 70 shows the Kaplan-Meier estimated metastasis-free survival curves for a CpG position of the PLAU gene by means of Real-Time methylation specific probe analysis according to Example 2. The X axis shows the disease free survival times of the patients in years, and the Y-axis shows the proportion of patients with metastasis free survival. The black plot shows the proportion of metastasis free patients in the population with above an optimised cut off point's methylation levels, the grey plot shows the proportion of disease free patients in the population with below an optimised cut off point's methylation levels.
Figure 71:
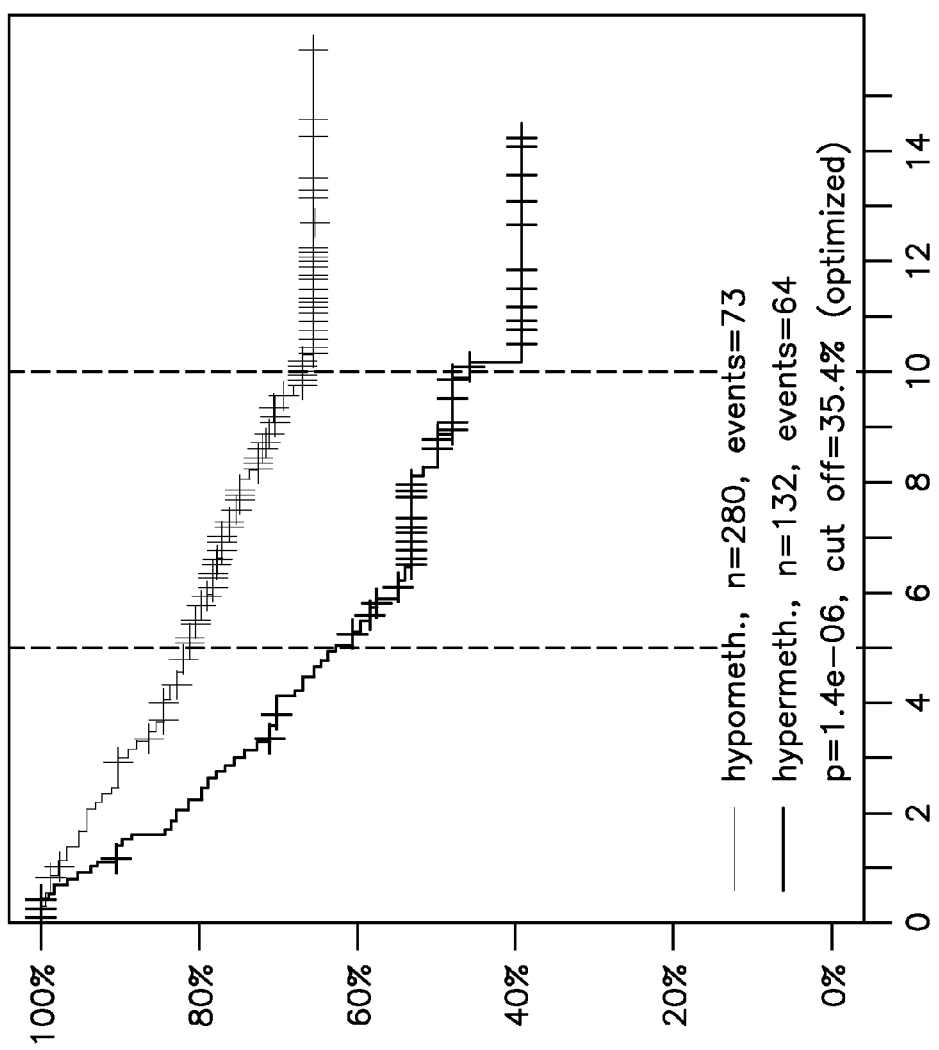
FIG. 71 shows the Kaplan-Meier estimated disease-free survival curves for a CpG position of the PITX2 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 72:
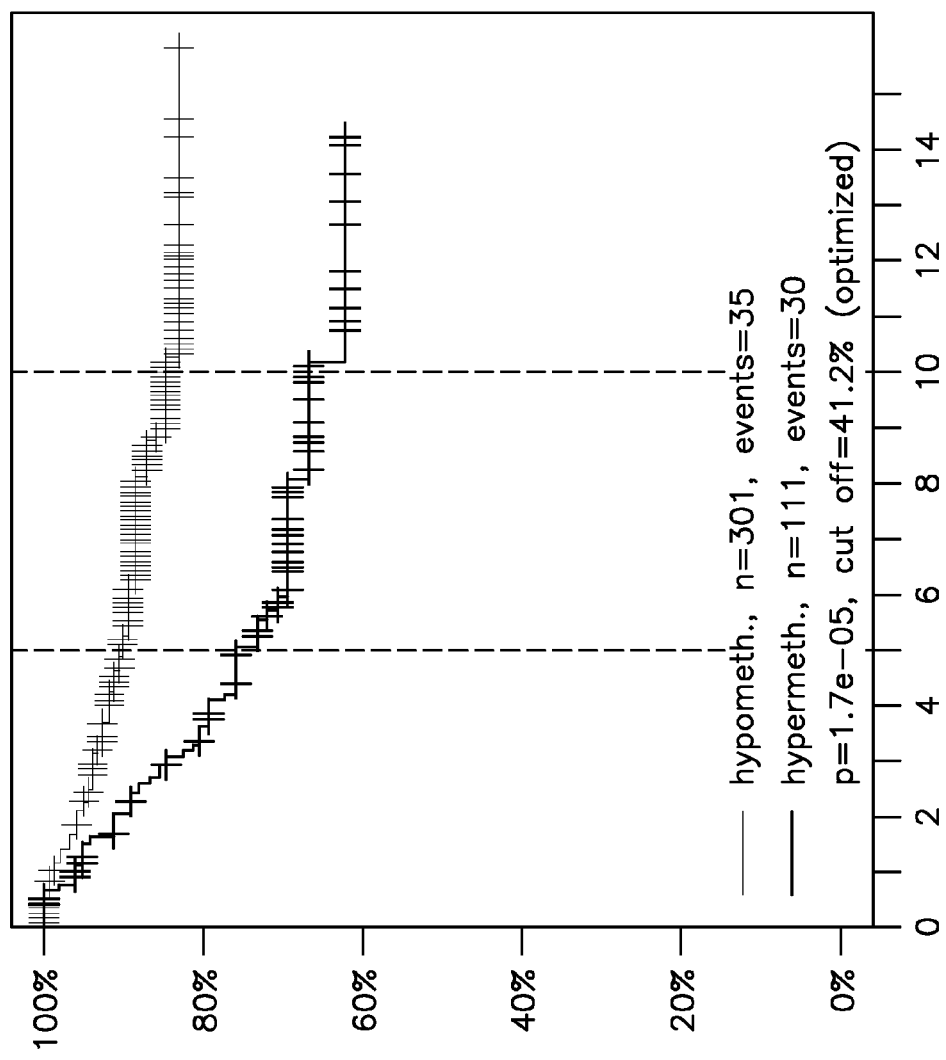
FIG. 72 shows the Kaplan-Meier estimated metastasis-free survival curves for a CpG position of the PITX2 gene by means of Real-Time methylation specific probe analysis according to Example 2. The X axis shows the disease free survival times of the patients in years, and the Y-axis shows the proportion of patients with metastasis free survival. The black plot shows the proportion of disease free patients in the population with above an optimised cut off point's methylation levels, the grey plot shows the proportion of metastasis free patients in the population with below an optimised cut off point's methylation levels.
Figure 73:
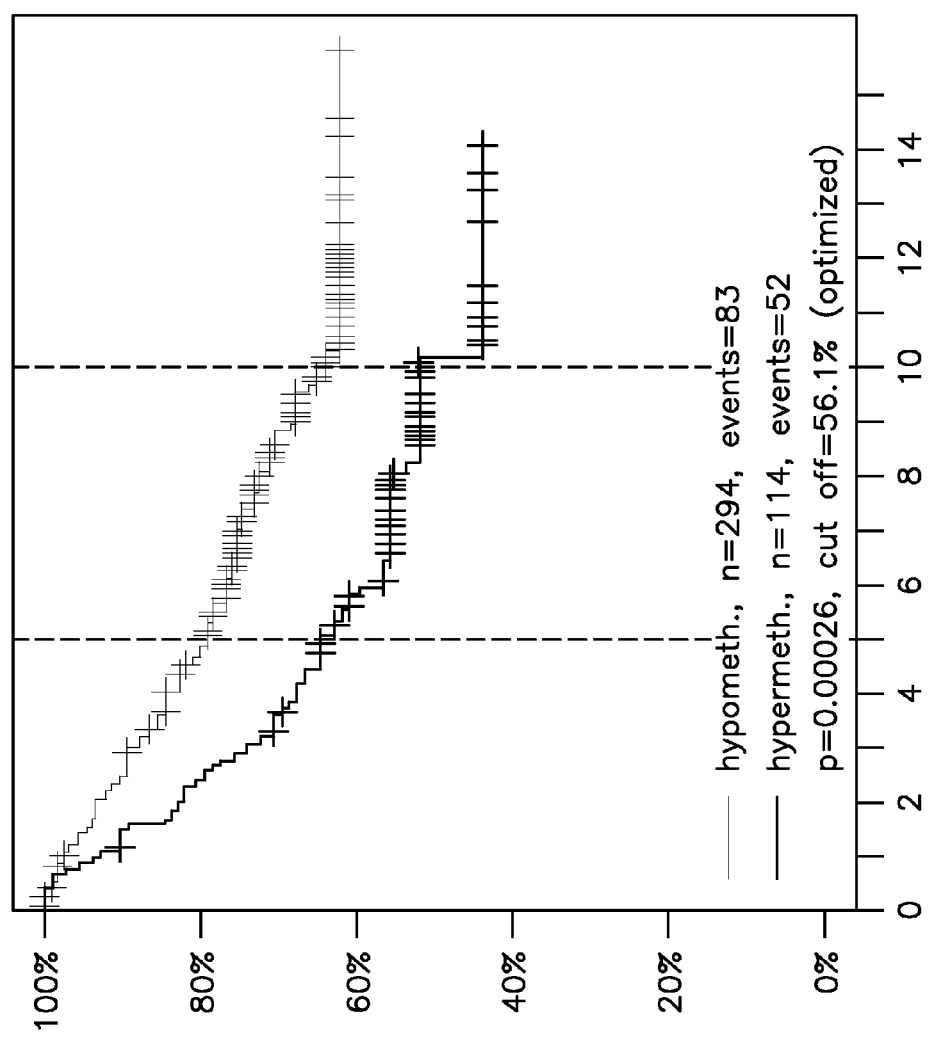
FIG. 73 shows the Kaplan-Meier estimated disease-free survival curves for a CpG position of the PITX2 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 74:
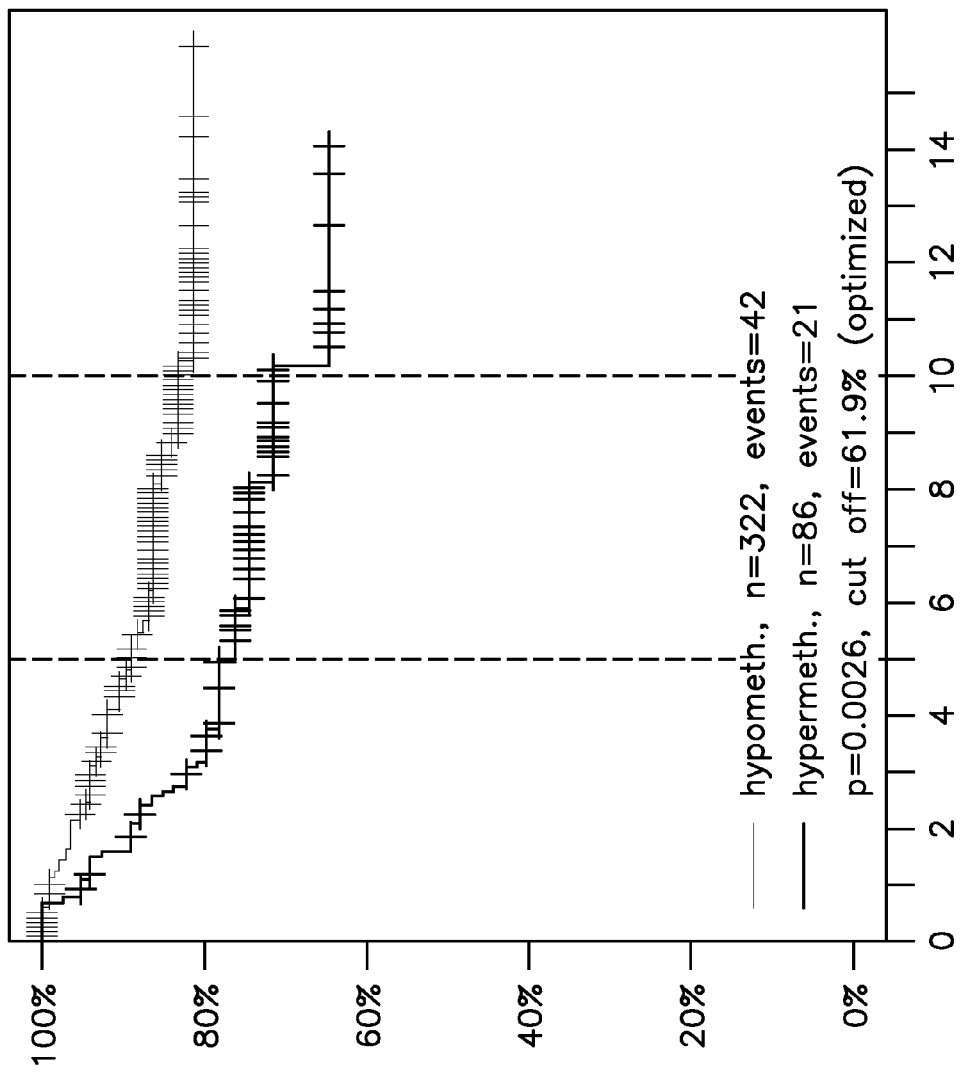
FIG. 74 shows the Kaplan-Meier estimated metastasis-free survival curves for a CpG position of the PITX2 gene by means of Real-Time methylation specific probe analysis according to Example 2. The X axis shows the disease free survival times of the patients in years, and the Y-axis shows the proportion of patients with metastasis free survival. The black plot shows the proportion of metastasis free patients in the population with above an optimised cut off point's methylation levels, the grey plot shows the proportion of disease free patients in the population with below an optimised cut off point's methylation levels.
Figure 75:
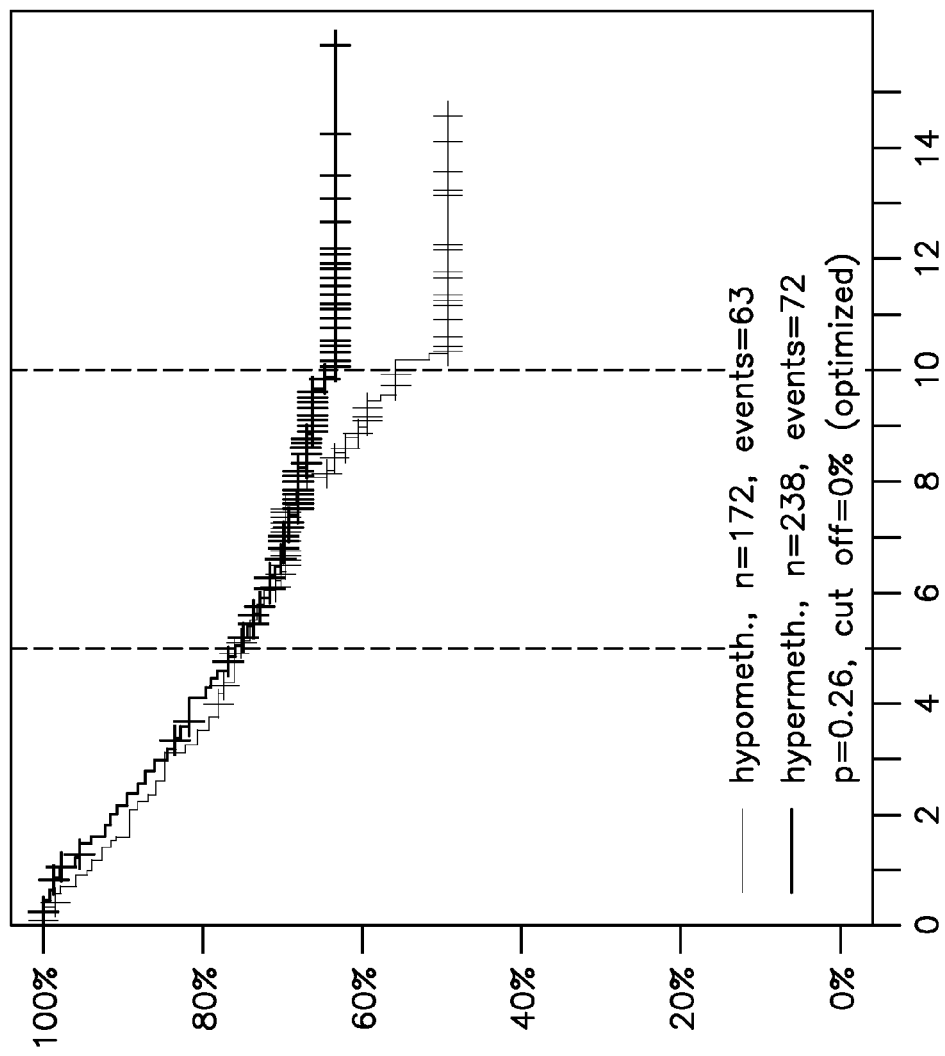
FIG. 75 shows the Kaplan-Meier estimated disease-free survival curves for a CpG position of the ONECUT2 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 76:
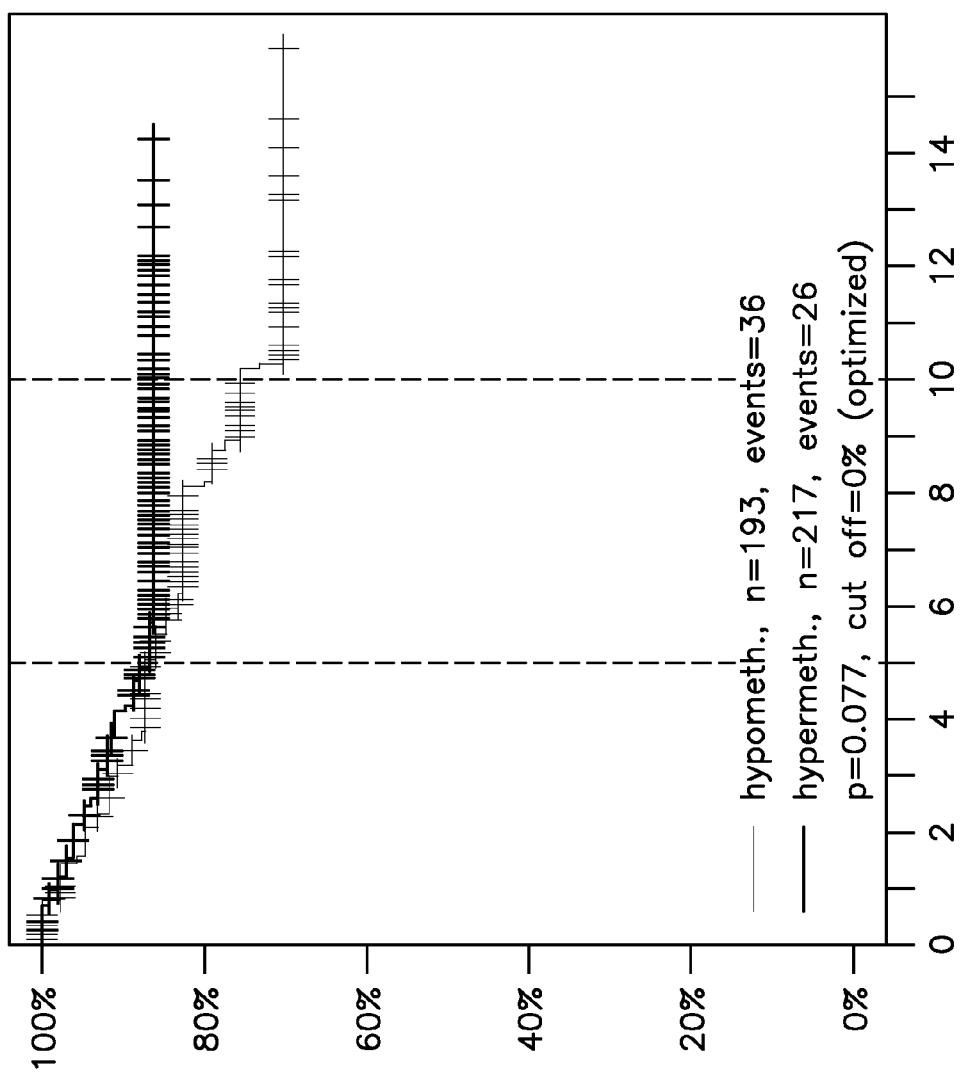
FIG. 76 shows the Kaplan-Meier estimated metastasis-free survival curves for a CpG position of the ONECUT2 gene by means of Real-Time methylation specific probe analysis according to Example 2. The X axis shows the metastasis free survival times of the patients in years, and the Y-axis shows the proportion of patients with metastasis free survival. The black plot shows the proportion of disease free patients in the population with above an optimised cut off point's methylation levels, the grey plot shows the proportion of disease free patients in the population with below an optimised cut off point's methylation levels.
Figure 77:
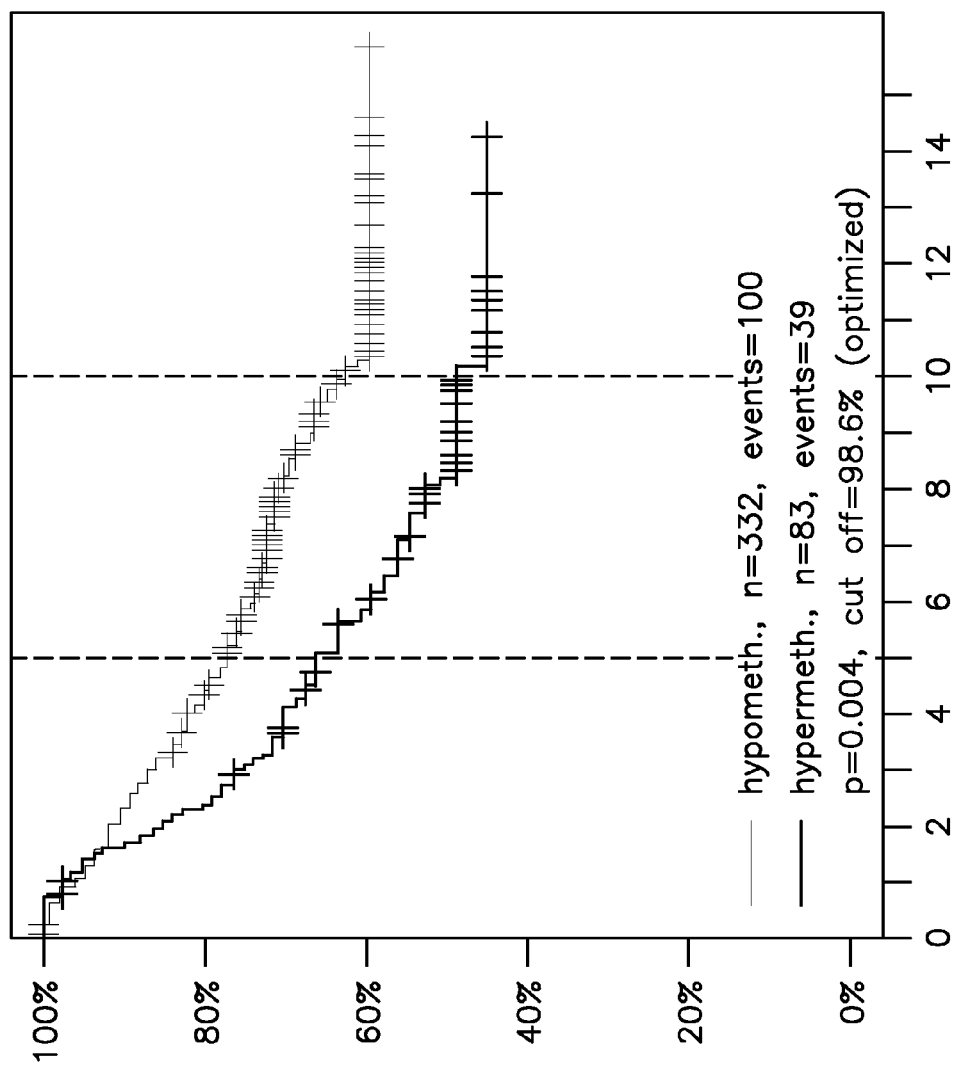
FIG. 77 shows the Kaplan-Meier estimated disease-free survival curves for a CpG position of the TBC1D3 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 78:
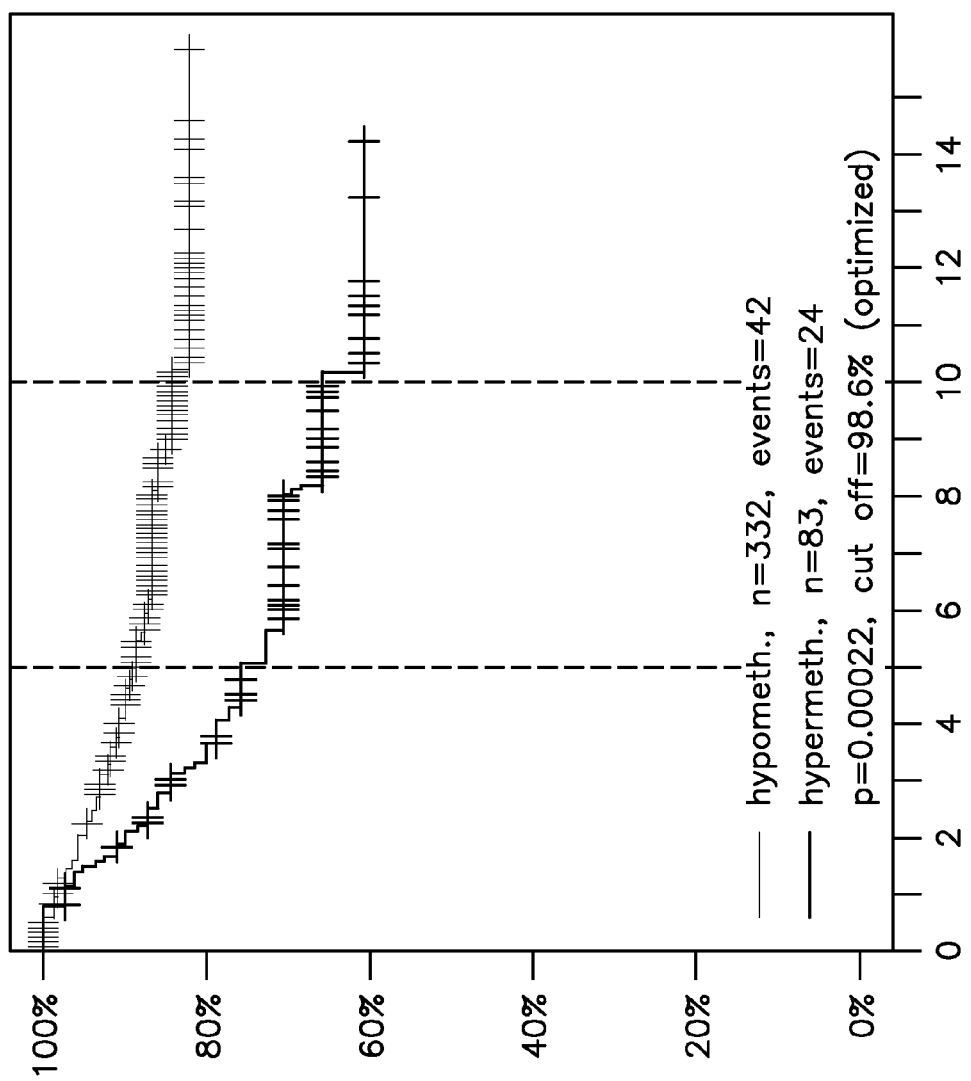
FIG. 78 shows the Kaplan-Meier estimated metastasis-free survival curves for a CpG position of the TBC1D3 gene by means of Real-Time methylation specific probe analysis according to Example 2. The X axis shows the metastasis free survival times of the patients in years, and the Y-axis shows the proportion of patients with metastasis free survival. The black plot shows the proportion of disease free patients in the population with above an optimised cut off point's methylation levels, the grey plot shows the proportion of disease free patients in the population with below an optimised cut off point's methylation levels.
Figure 79:
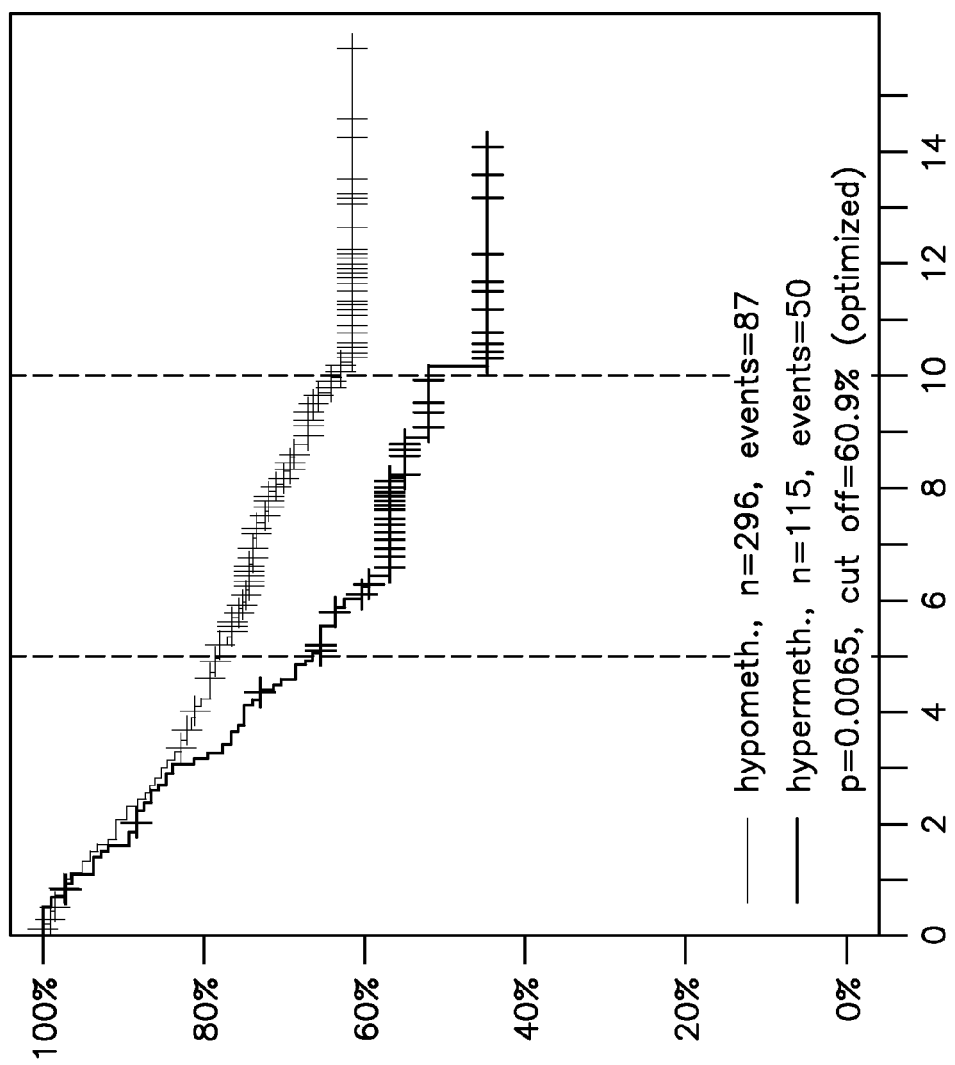
FIG. 79 shows the Kaplan-Meier estimated disease-free survival curves for a CpG position of the ABCA8 gene by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 80:
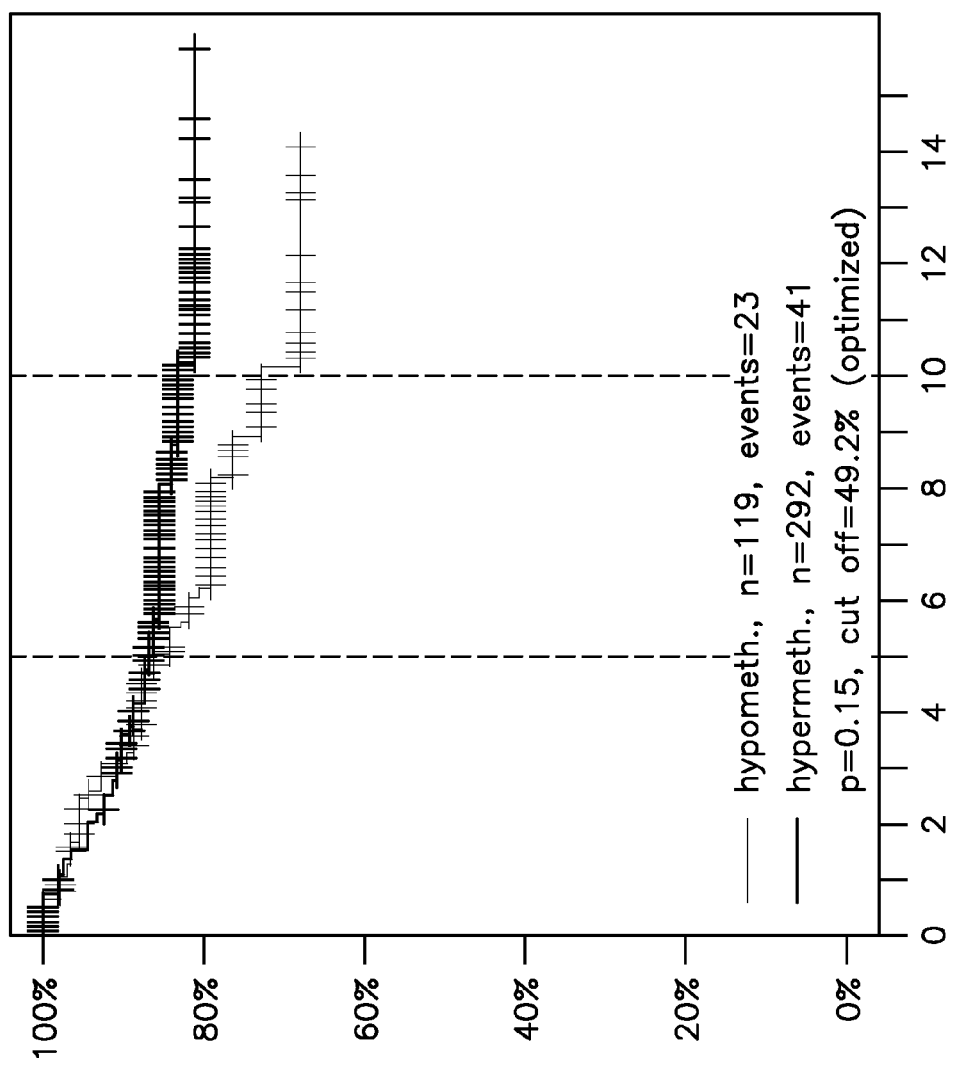
FIG. 80 shows the Kaplan-Meier estimated metastasis-free survival curves for a CpG position of the ABCA8 gene by means of Real-Time methylation specific probe analysis according to Example 2. The X axis shows the disease free survival times of the patients in years, and the Y-axis shows the proportion of patients with metastasis free survival. The black plot shows the proportion of metastasis free patients in the population with above an optimised cut off point's methylation levels, the grey plot shows the proportion of disease free patients in the population with below an optimised cut off point's methylation levels.
Figure 81:
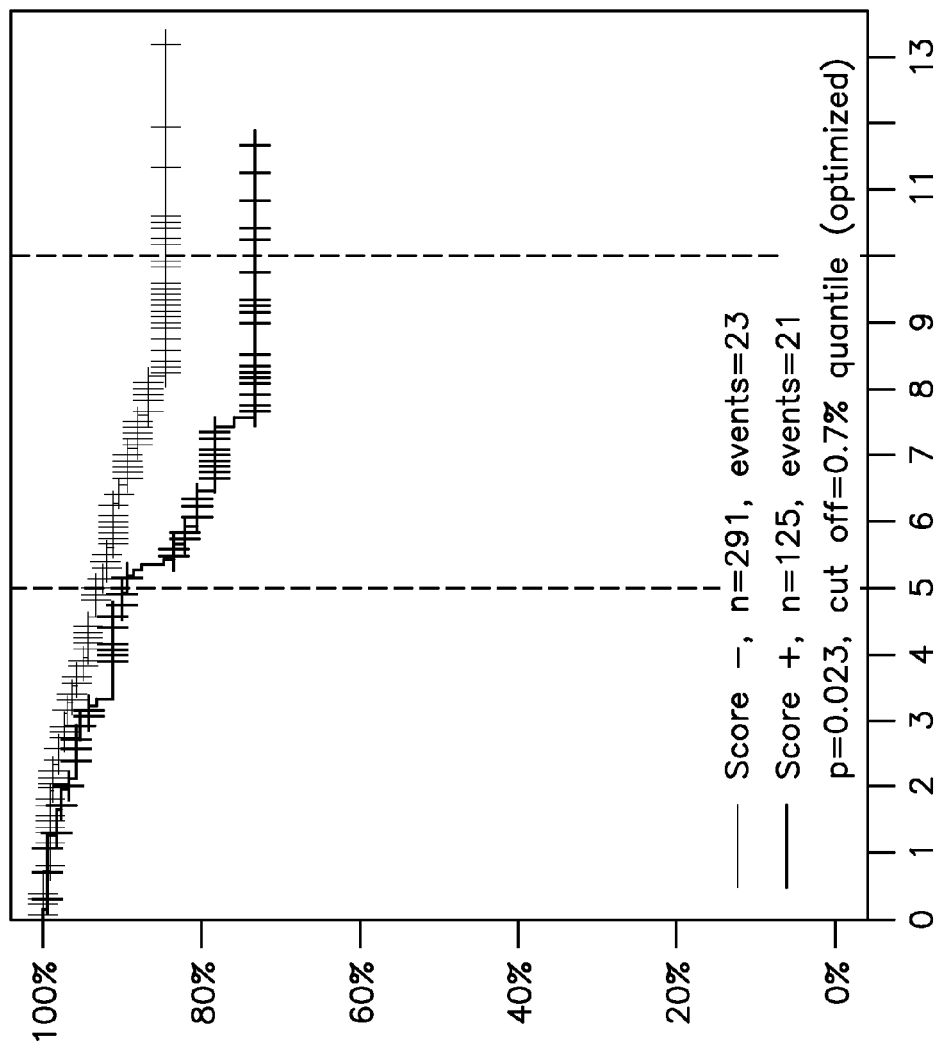
FIG. 81 shows the Kaplan-Meier estimated disease-free survival curves for a CpG position of a combination of the TFF1 (SEQ ID NO: 12) and PLAU (SEQ ID NO:16) genes by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 82:
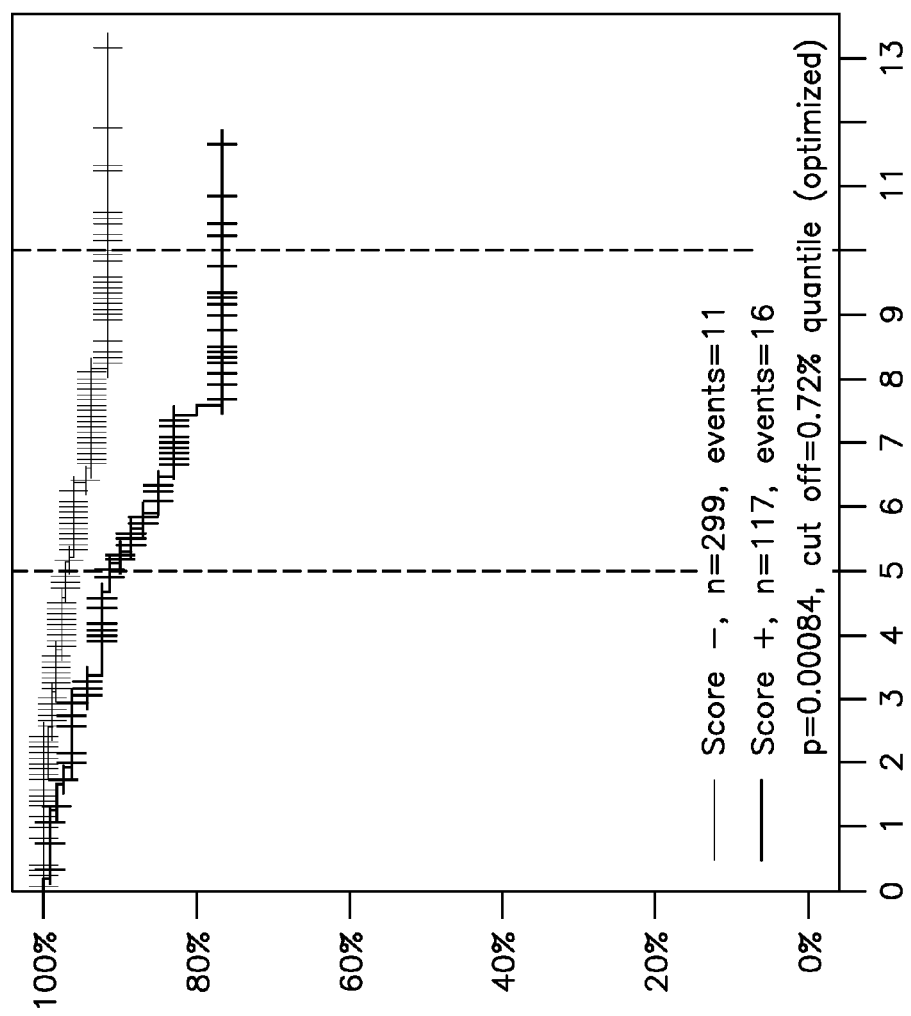
FIG. 82 shows the Kaplan-Meier estimated metastasis-free survival curves for a CpG position of a combination of the TFF1 (SEQ ID NO: 12) and PLAU (SEQ ID NO:16) genes by means of Real-Time methylation specific probe analysis according to Example 2. The X axis shows the metastasis free survival times of the patients in years, and the Y-axis shows the proportion of patients with metastasis free survival. The black plot shows the proportion of disease free patients in the population with above an optimised cut off point's methylation levels, the grey plot shows the proportion of disease free patients in the population with below an optimised cut off point's methylation levels.
Figure 83:
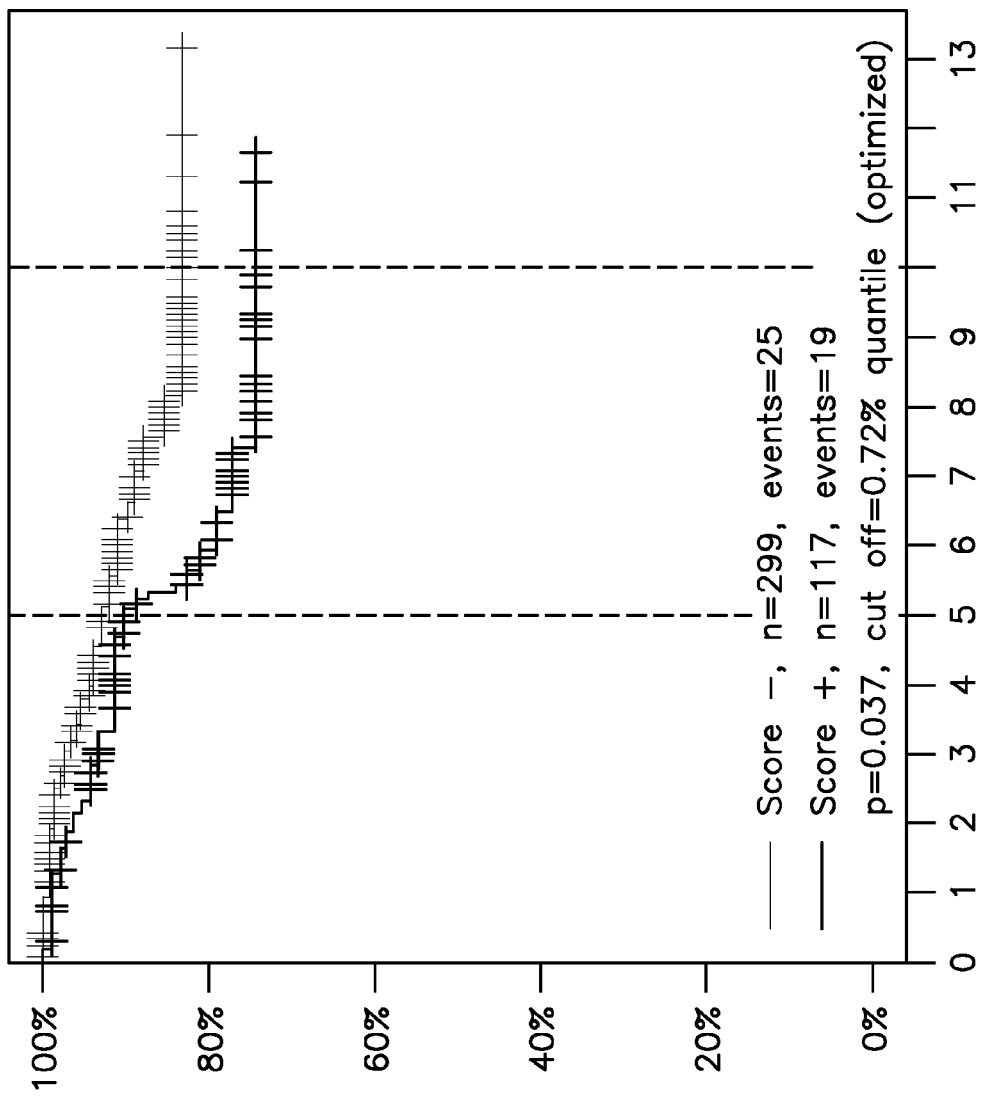
FIG. 83 shows the Kaplan-Meier estimated disease-free survival curves for a CpG position of a combination of the TFF1 (SEQ ID NO: 12) and PLAU (SEQ ID NO:16) and PITX2 (SEQ ID NO:23) genes by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 84:
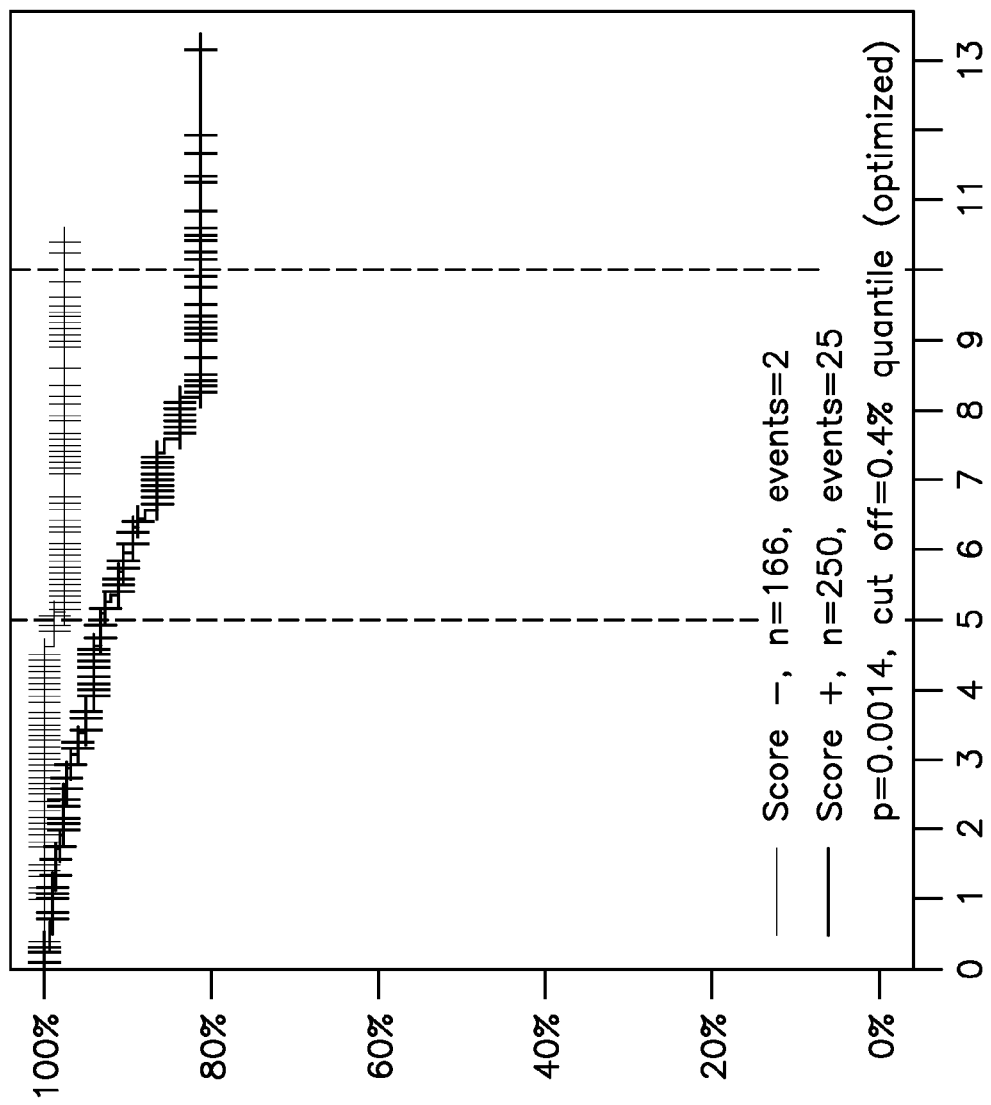
FIG. 84 shows the Kaplan-Meier estimated metastasis-free survival curves for a CpG position of a combination of the TFF1 (SEQ ID NO: 12) and PLAU (SEQ ID NO:16) and PITX2 (SEQ ID NO:23) genes by means of Real-Time methylation specific probe analysis according to Example 2. The X axis shows the disease free survival times of the patients in years, and the Y-axis shows the proportion of patients with metastasis free survival. The black plot shows the proportion of metastasis free patients in the population with above an optimised cut off point's methylation levels, the grey plot shows the proportion of disease free patients in the population with below an optimised cut off point's methylation levels.
Figure 85:
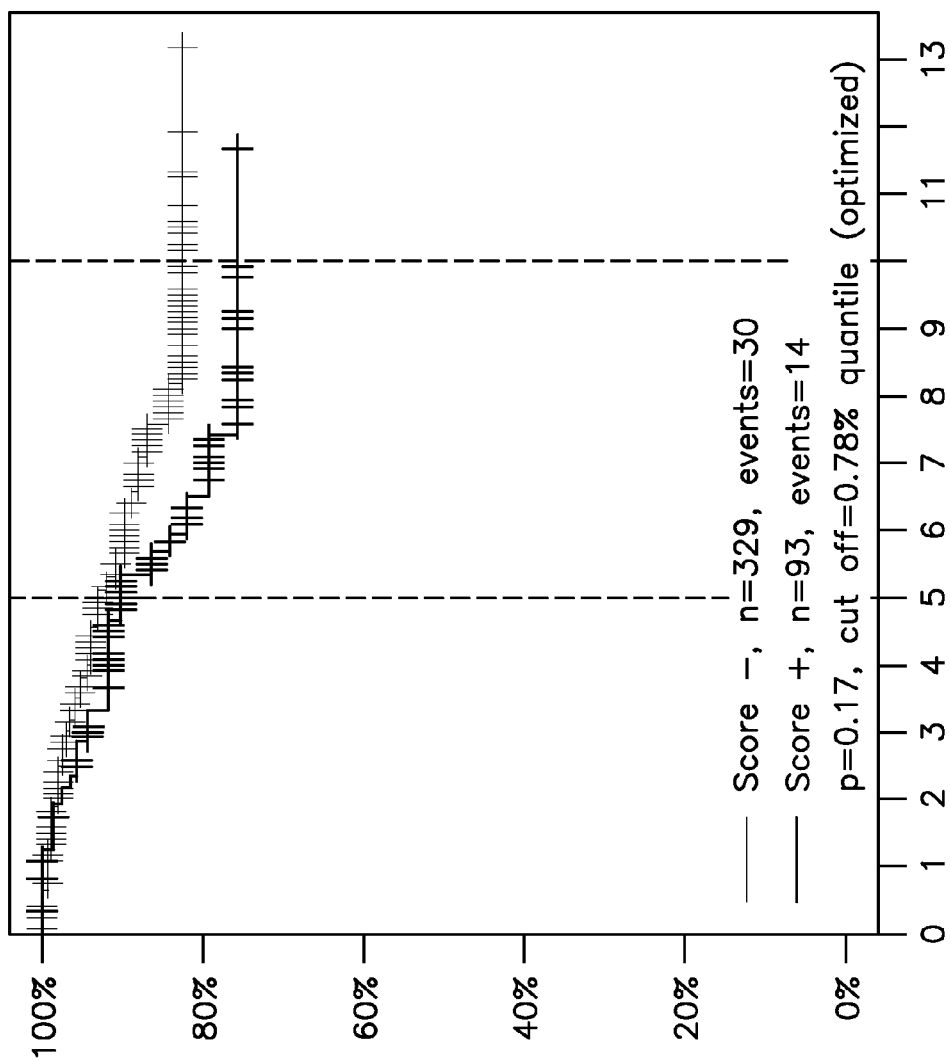
FIG. 85 shows the Kaplan-Meier estimated disease-free survival curves for a CpG position of a combination of the PITX2 (SEQ ID NO:23) and TFF1 (SEQ ID NO: 12) genes by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 86:
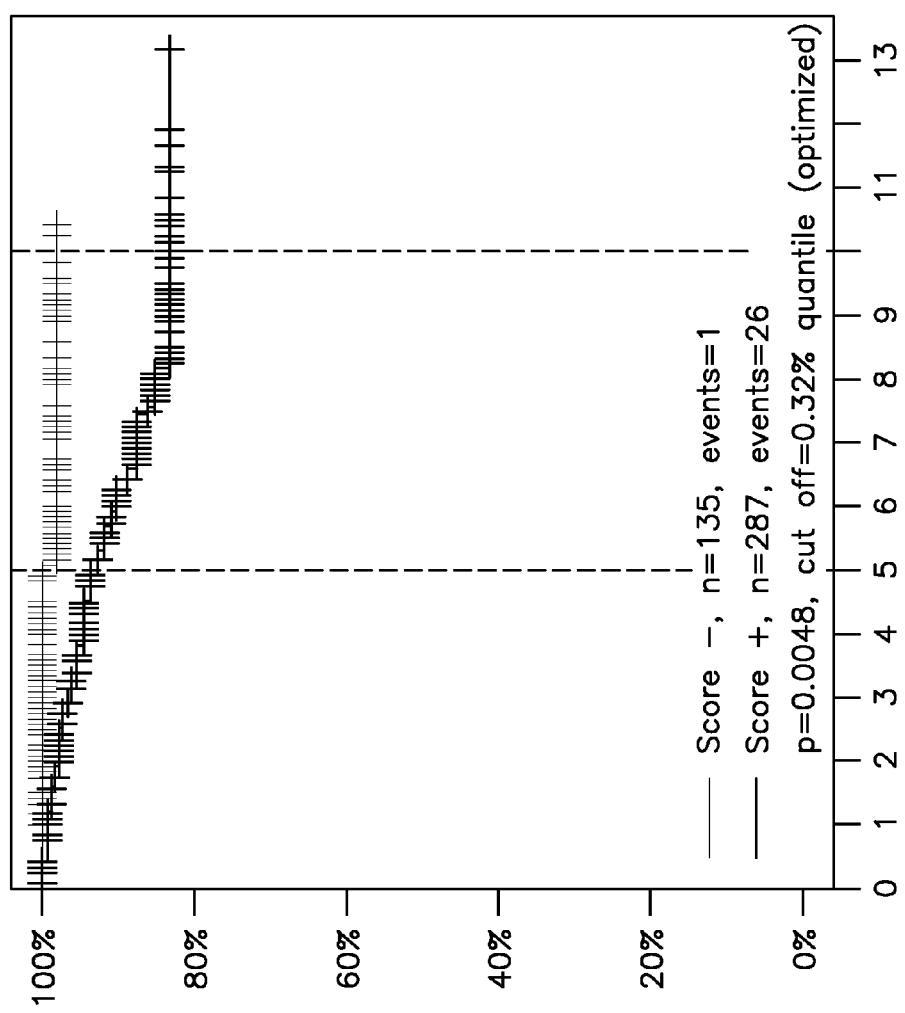
FIG. 86 shows the Kaplan-Meier estimated metastasis-free survival curves for a CpG position a combination of the PITX2 (SEQ ID NO:23) and TFF1 (SEQ ID NO: 12) genes by means of Real-Time methylation specific probe analysis according to Example 2. The X axis shows the metastasis free survival times of the patients in years, and the Y-axis shows the proportion of patients with metastasis free survival. The black plot shows the proportion of disease free patients in the population with above an optimised cut off point's methylation levels, the grey plot shows the proportion of disease free patients in the population with below an optimised cut off point's methylation levels.
Figure 87:
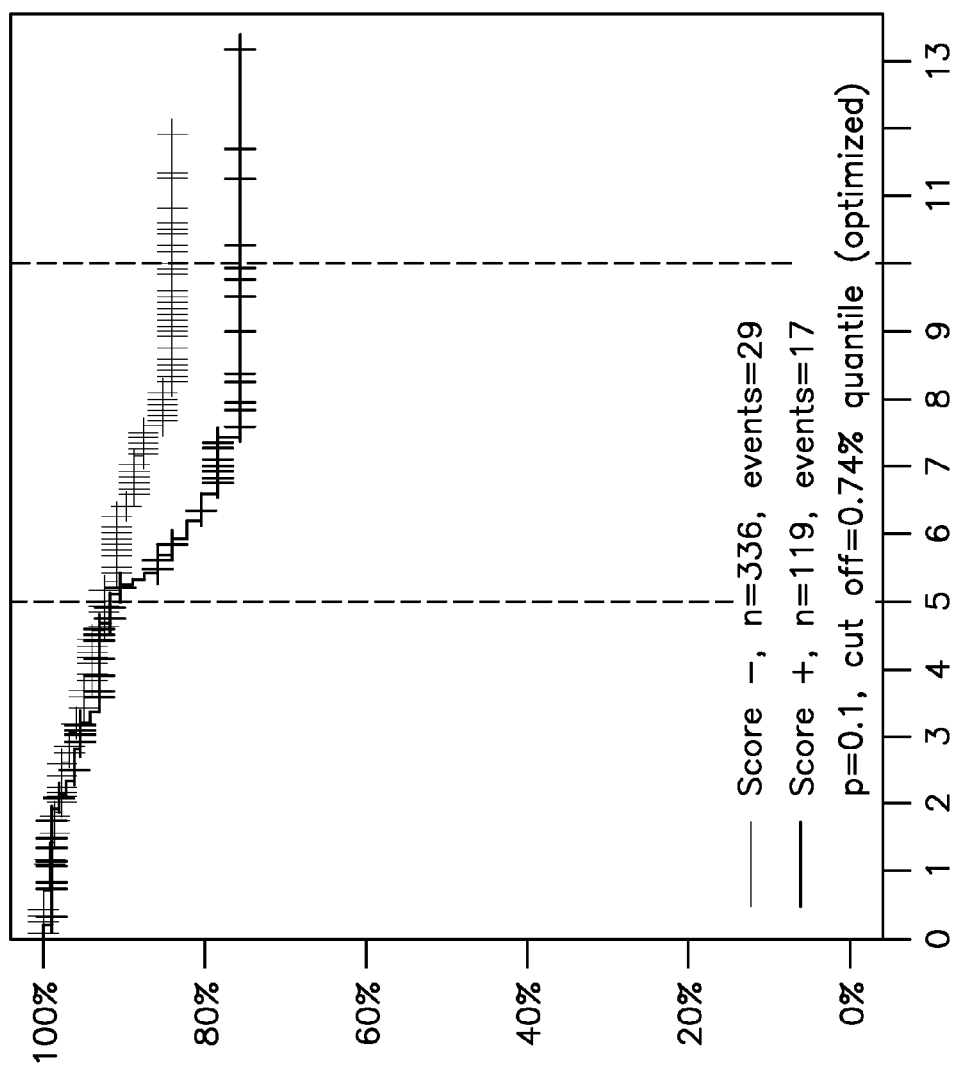
FIG. 87 shows the Kaplan-Meier estimated disease-free survival curves for a CpG position of a combination of the PITX2 (SEQ ID NO:23) and PLAU (SEQ ID NO: 16) genes by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 88:
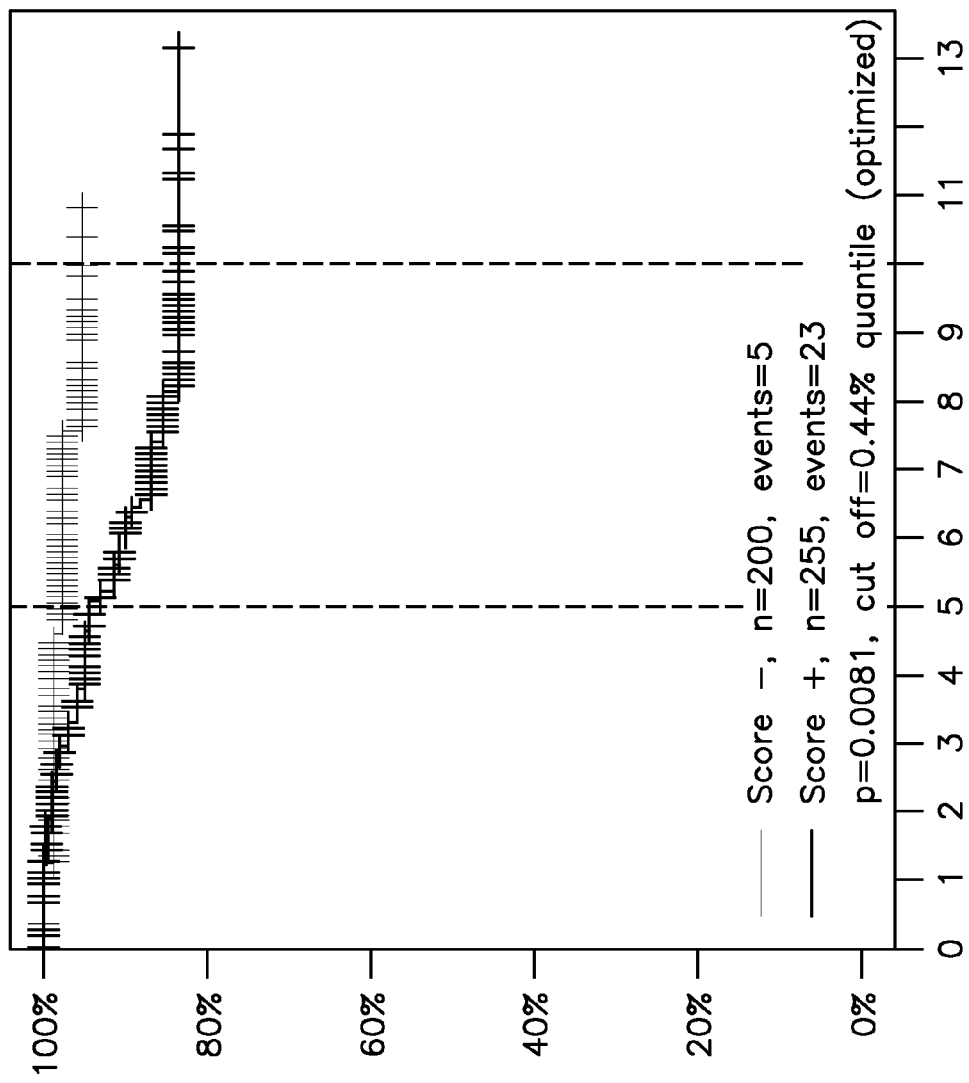
FIG. 88 shows the Kaplan-Meier estimated metastasis-free survival curves for a CpG position of a combination of the PITX2 (SEQ ID NO:23) and PLAU (SEQ ID NO: 16) genes by means of Real-Time methylation specific probe analysis according to Example 2. The X axis shows the metastasis free survival times of the patients in years, and the Y-axis shows the proportion of patients with metastasis free survival. The black plot shows the proportion of disease free patients in the population with above an optimised cut off point's methylation levels, the grey plot shows the proportion of disease free patients in the population with below an optimised cut off point's methylation levels.
Figure 89:
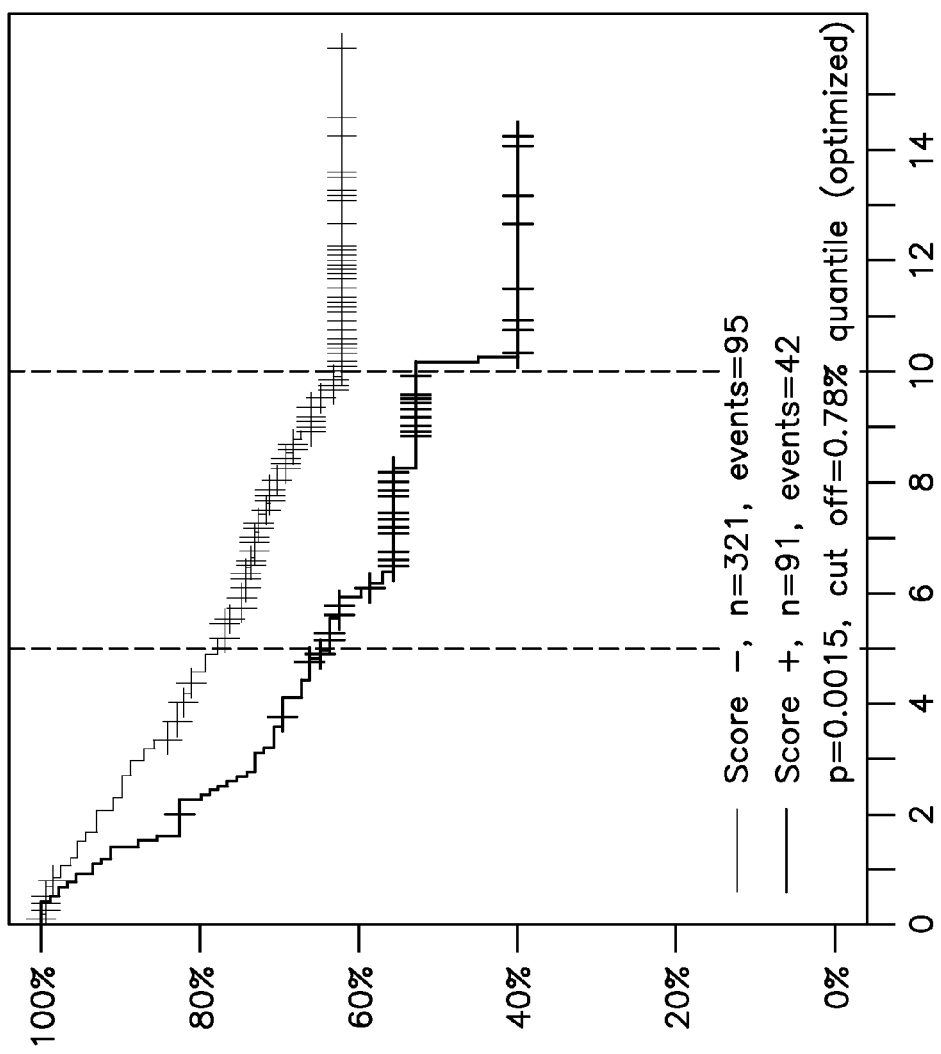
FIG. 89 shows the Kaplan-Meier estimated disease-free survival curves for a CpG position of a combination of the TFF1 (SEQ ID NO: 12) and PLAU (SEQ ID NO: 16) genes by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 90:
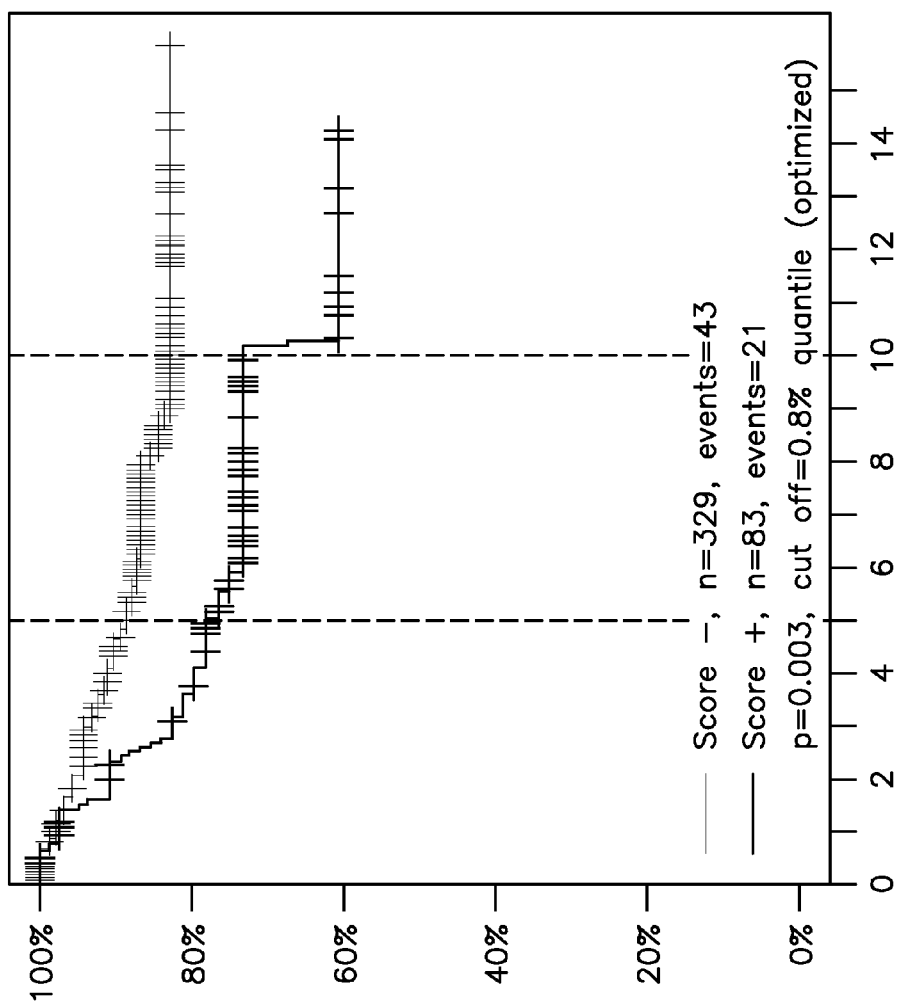
FIG. 90 shows the Kaplan-Meier estimated metastasis-free survival curves for a CpG position of a combination of the TFF1 (SEQ ID NO: 12) and PLAU (SEQ ID NO:16) genes by means of Real-Time methylation specific probe analysis according to Example 2. The X axis shows the disease free survival times of the patients in years, and the Y-axis shows the proportion of patients with metastasis free survival. The black plot shows the proportion of metastasis free patients in the population with above an optimised cut off point's methylation levels, the grey plot shows the proportion of disease free patients in the population with below an optimised cut off point's methylation levels.
Figure 91:
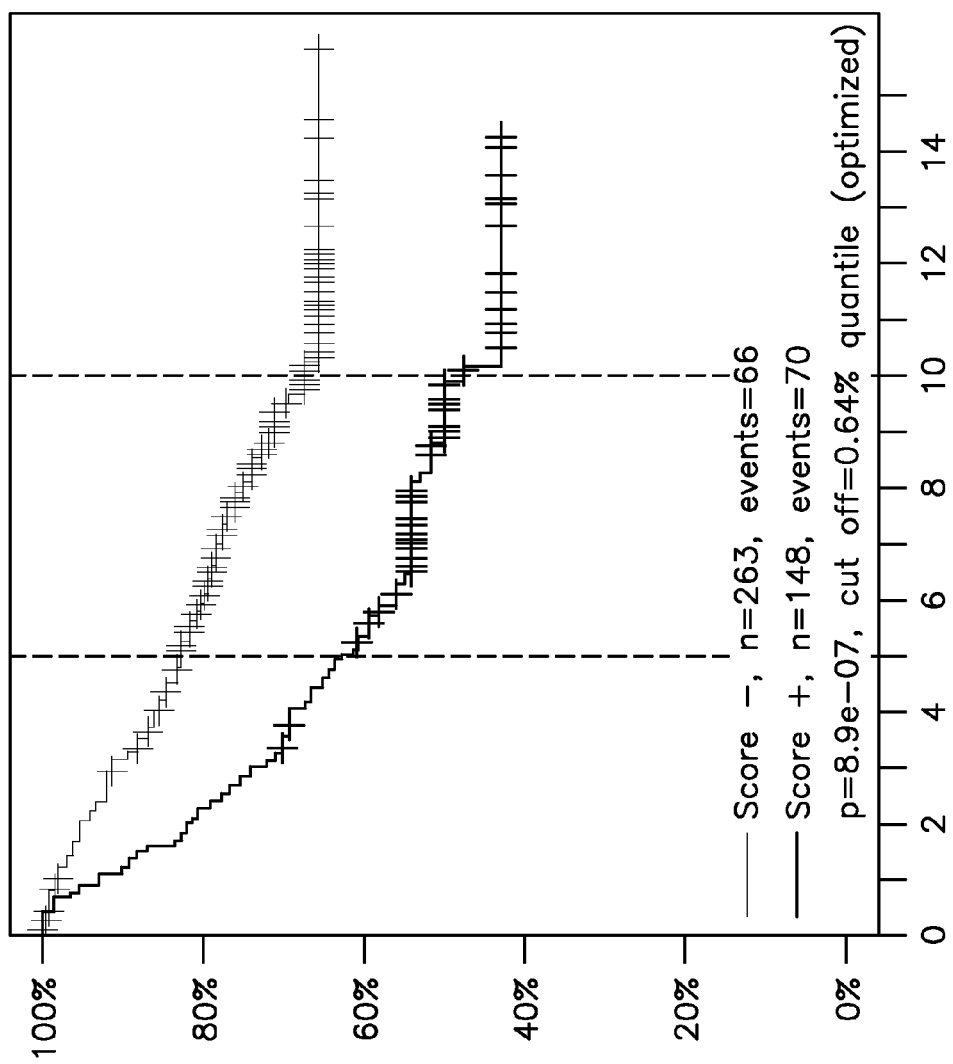
FIG. 91 shows the Kaplan-Meier estimated disease-free survival curves for a CpG position of a combination of the TFF1 (SEQ ID NO: 12) and PLAU (SEQ ID NO:16) and PITX2 (SEQ ID NO:23) genes by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 92:
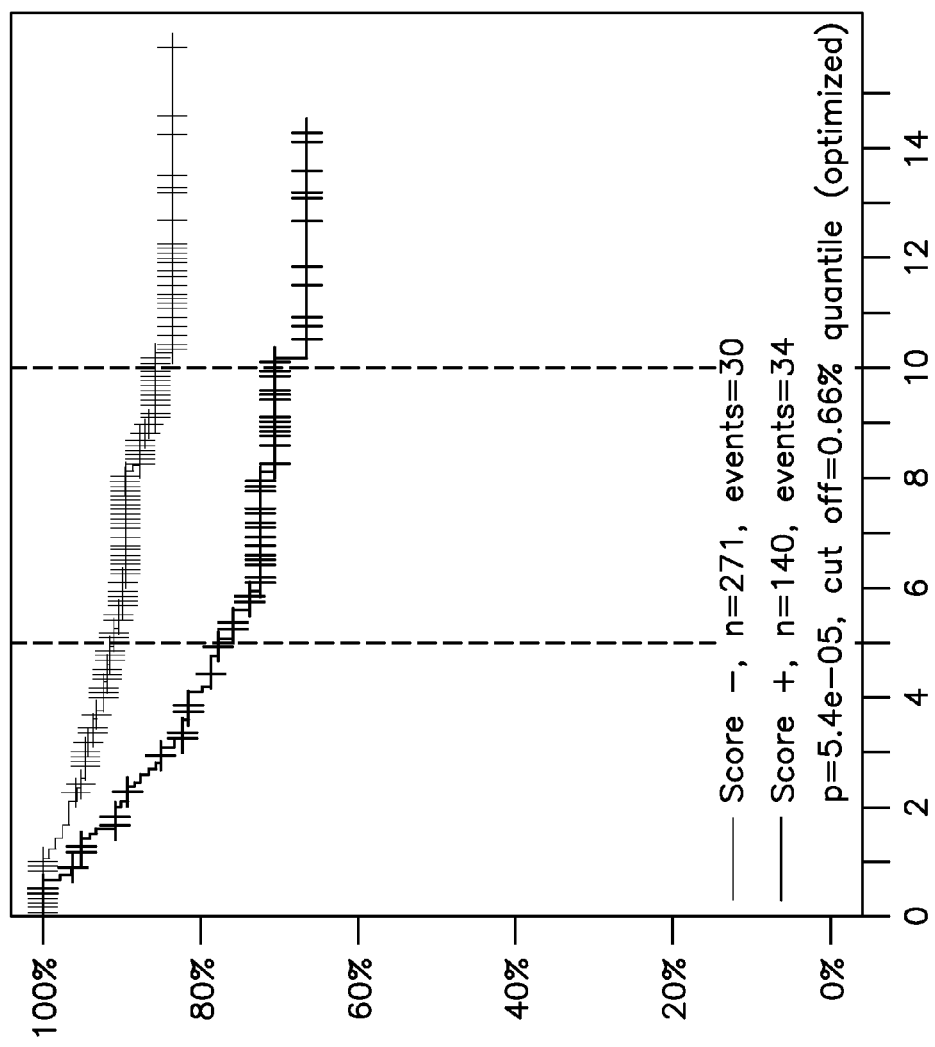
FIG. 92 shows the Kaplan-Meier estimated metastasis-free survival curves for a CpG position of a combination of the TFF1 (SEQ ID NO: 12) and PLAU (SEQ ID NO: 16) and PITX2 (SEQ ID NO:23) genes by means of Real-Time methylation specific probe analysis according to Example 2. The X axis shows the metastasis free survival times of the patients in years, and the Y-axis shows the proportion of patients with metastasis free survival. The black plot shows the proportion of disease free patients in the population with above an optimised cut off point's methylation levels, the grey plot shows the proportion of disease free patients in the population with below an optimised cut off point's methylation levels.
Figure 93:
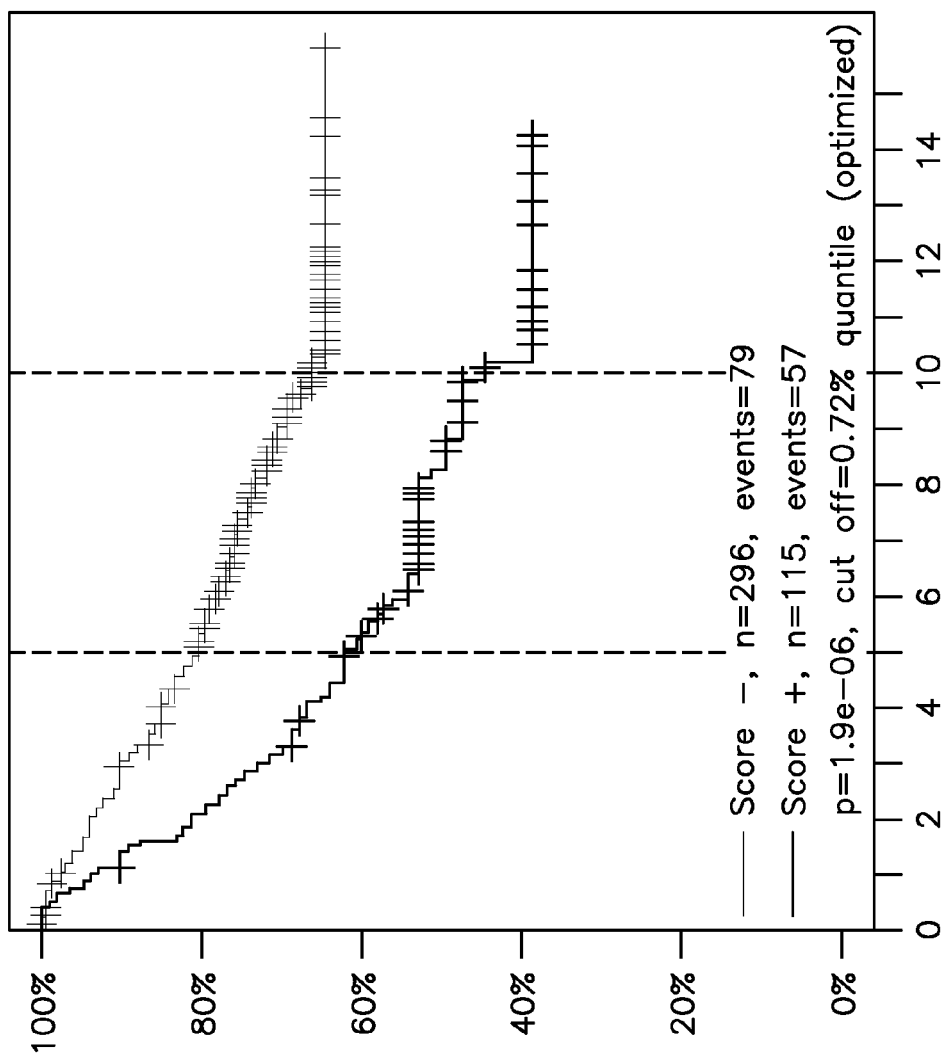
FIG. 93 shows the Kaplan-Meier estimated disease-free survival curves for a CpG position of a combination of the PITX2 (SEQ ID NO:23) and TFF1 (SEQ ID NO: 12) genes by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 94:
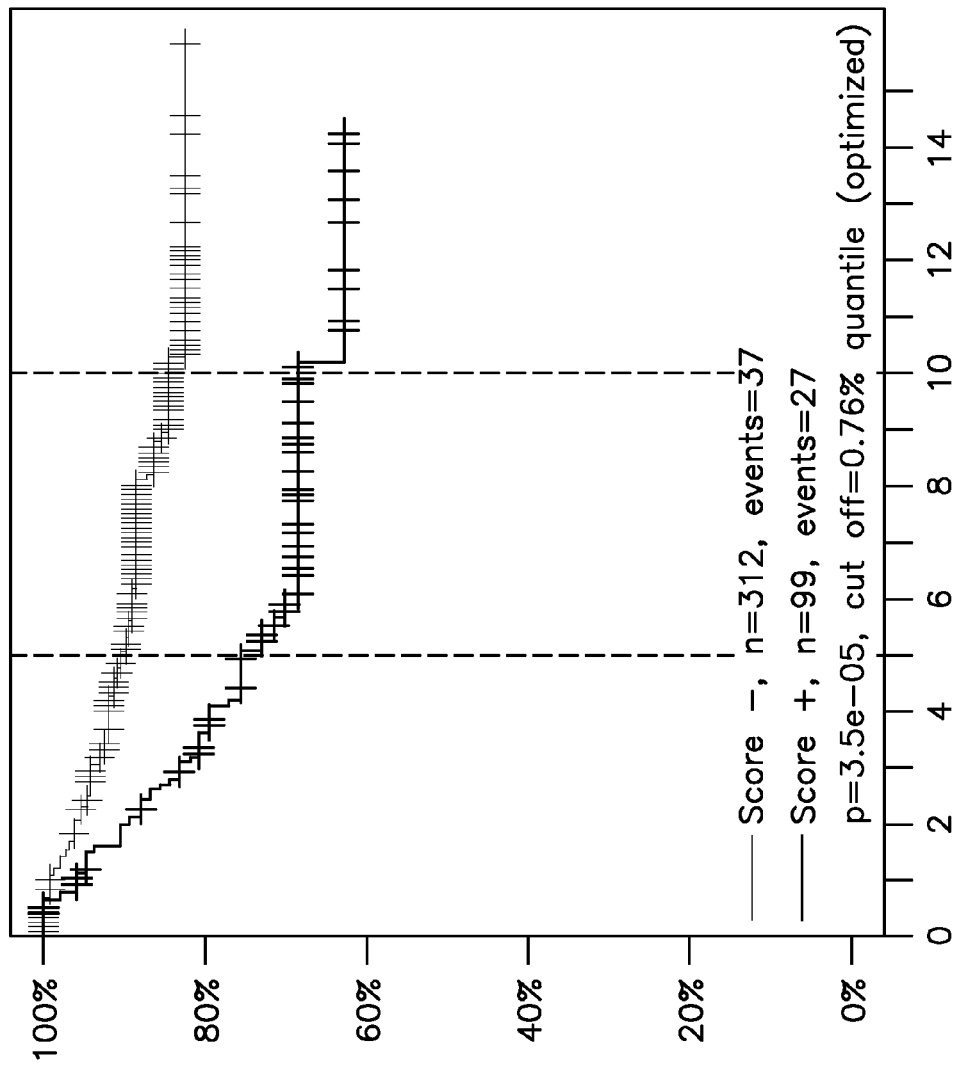
FIG. 94 shows the Kaplan-Meier estimated metastasis-free survival curves for a CpG position of a combination of the PITX2 (SEQ ID NO:23) and TFF1 (SEQ ID NO: 12) genes by means of Real-Time methylation specific probe analysis according to Example 2. The X axis shows the metastasis free survival times of the patients in years, and the Y-axis shows the proportion of patients with metastasis free survival. The black plot shows the proportion of disease free patients in the population with above an optimised cut off point's methylation levels, the grey plot shows the proportion of disease free patients in the population with below an optimised cut off point's methylation levels.
Figure 95:
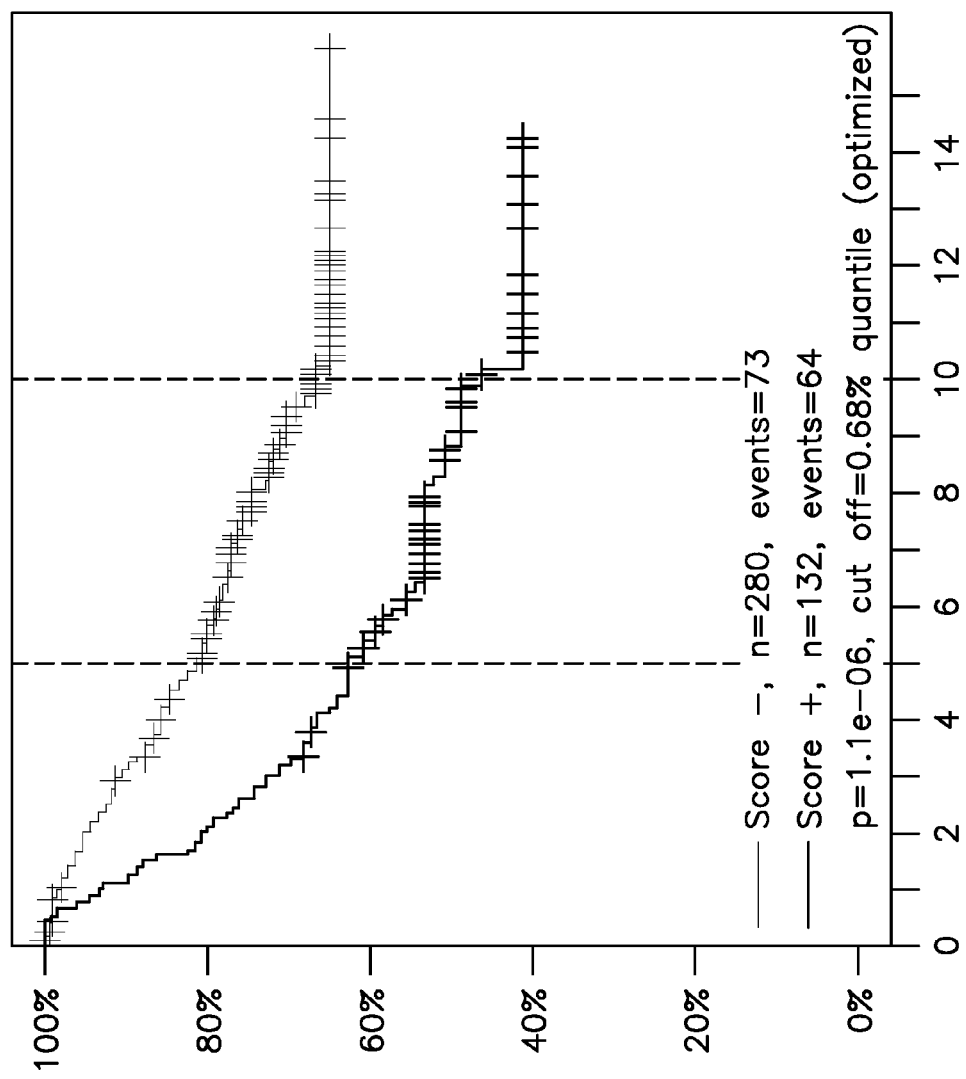
FIG. 95 shows the Kaplan-Meier estimated disease-free survival curves for a CpG position of a combination of the PITX2 (SEQ ID NO:23) and PLAU (SEQ ID NO:16) genes by means of Real-Time methylation specific probe analysis according to Example 2. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.
Figure 96:
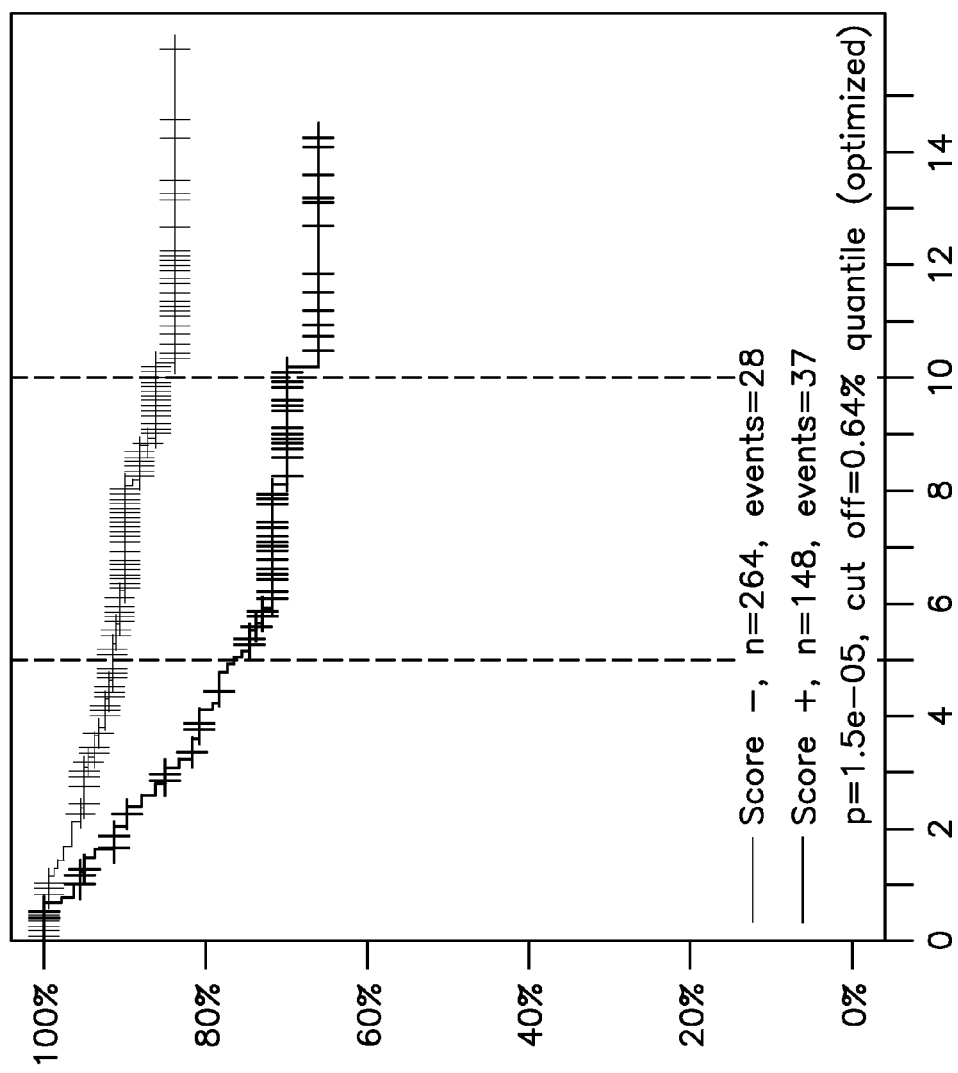
FIG. 96 shows the Kaplan-Meier estimated metastasis-free survival curves for a CpG position of a combination of the PITX2 (SEQ ID NO:23) and PLAU (SEQ ID NO:16) genes by means of Real-Time methylation specific probe analysis according to Example 2. The X axis shows the disease free survival times of the patients in years, and the Y-axis shows the proportion of patients with metastasis free survival. The black plot shows the proportion of metastasis free patients in the population with above an optimised cut off point's methylation levels, the grey plot shows the proportion of disease free patients in the population with below an optimised cut off point's methylation levels.

FIG. 54 shows the Kaplan-Meier estimated disease-free survival curves for a CpG position of the PITX2 gene by means of Real-Time methylation specific probe analysis. The lower plot shows the proportion of disease free patients in the population with above median methylation levels, the upper plot shows the proportion of disease free patients in the population with below median methylation levels. The X axis shows the disease free survival times of the patients in months, and the Y-axis shows the proportion of disease free survival patients. The p-value (probability that the observed distribution occurred by chance) was calculated as 0.0031, thereby confirming the data obtained by means of array analysis according to FIG. 6.

EXAMPLE 2

In order to validate the most promising markers from the microarray study of Example 1 Real-Time assays were designed and optimised in order to provide assays of optimum accuracy. The assays were run on a combination of paraffin embedded tissue (hereinafter also referred to as PET) and fresh frozen tissue samples. DNA derived from PET is often of 'lower quality' (e.g. higher degree of DNA fragmentation and low DNA yield from samples), thus confirmation of assay results on PET demonstrates the robustness of the assay and increased utility of the marker.

Quantitative methylation assays were designed for the genes ERBB2 (SEQ ID NO: 5), TFF1 (SEQ ID NO: 12), PLAU (SEQ ID NO:16), PITX2 (SEQ ID NO:23), ONE-CUT2 (SEQ ID NO:35), TBC1D3 (SEQ ID NO: 43), and ABCA8 (SEQ ID NO: 49) and tested using a sample set of 415 estrogen receptor positive node negative samples untreated breast cancer patients and 541 estrogen receptor positive node negative samples Tamoxifen treated samples. Approximately 100 of these samples were previously analysed in the microarray study.

The QM assay (=Quantitative Methylation Assay) is a Real-time PCR based method for quantitative DNA methylation detection. The assay principle is based on non-methylation specific amplification of the target region and a methylation specific detection by competitive hybridization of two different probes specific for the CG or the TG status, respectively. For the present study, TaqMan probes were used that were labeled with two different fluorescence dyes ("FAM" for CG specific probes, "VIC" for TG specific probes) and were further modified by a quencher molecule ("TAMRA" or "Minor Groove Binder/non-fluorescent quencher").

Evaluation of the QM assay raw data is possible with two different methods:
1. Measuring absolute fluorescence intensities (FI) in the logarithmic phase of amplification
2. Difference in threshold cycles (Ct) of CG and TG specific probe.

Results of this study were generated by using the Ct method.

In the following series of quantitative methylation assays the amount of sample DNA amplified is quantified by reference to the gene GSTP1 to normalize for input DNA. For standardization, the primers and the probe for analysis of the GSTP1 gene lack CpG dinucleotides so that amplification is possible regardless of methylation levels. As there are no methylation variable positions, only one probe oligonucleotide is required.

Sample Sets
ER+N0 Untreated Population

To demonstrate that the markers identified have a strong prognostic component, ER+N0 tumor samples from patients not treated with any adjuvant therapy were analyzed. Markers that are able to show a significant survival difference in this population are considered to be prognostic. All 508 samples of this set were obtained from an academic collaborator as cell nuclei pellets (fresh frozen samples). The sample population can be divided into two subsets: One with 415 randomly selected samples (from both censored and relapsing patients), representing a population with a natural distribution of relapses, and additional 93 samples from relapsing patients only. The latter samples were used for sensitivity/specificity analyses only.

Figure 98:
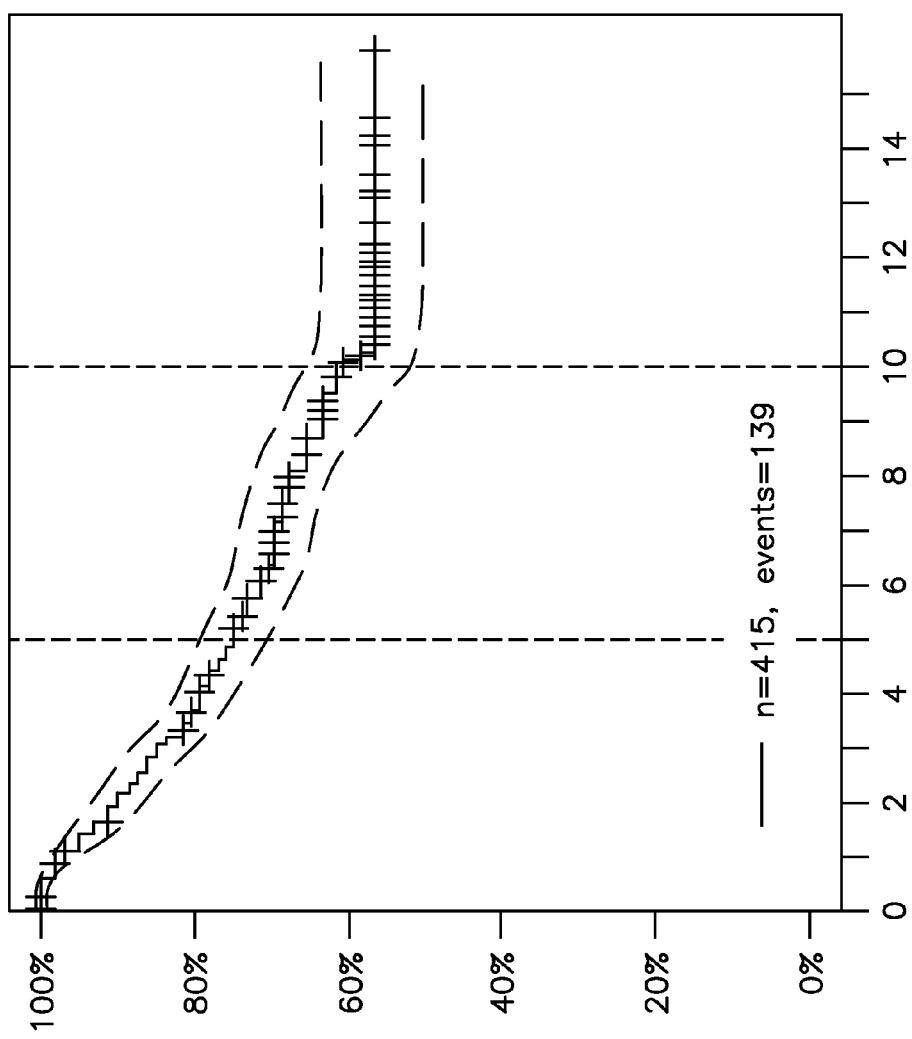
FIG. 98 shows the Disease free survival (DFS) of randomly selected ER+, N0, untreated patient population in Kaplan-Meier survival plot according to Example 2. Proportion of disease free patients is shown on the Y-axis and time in years is shown on the X-axis. 139 events were observed (observed event rate=33%). Disease free survival after 5 years: 74.5% [70.3%, 78.9%], after 10 years 59.8% [54.2%, 66%]. 95% confidence intervals are plotted.

FIG. 98 shows the disease-free survival of the randomly selected population in a Kaplan-Meier plot and FIG. 99 the distribution of follow-up times for the relapsed and censored patients in histograms. Table 4 lists the number of events broken down by different kinds of relapse. In summary, the survival of this population is comparable to the expected one from the literature.

ER+N0 TAM Treated Population

One intended target population of the invention is patients with ER+N0 tumors that are treated with hormone therapy. To check the performance of the marker candidates in this population, 589 samples from ER+N0 tumors from patients treated with Tamoxifen were analyzed. All samples were received as Paraffin-embedded tissues (PET). Three to ten 10 μm sections were provided.

In addition, for 89 PET patient samples matching fresh frozen samples from the same tumor were included into the study as controls. As these samples were already used in phase 1, they allowed for two kinds of concordance studies:
Chip versus QM assay
Fresh frozen versus PET samples Samples of the ER+, N0, TAM treated population were received from eight different providers. Altogether 589 samples were processed, 48 of which had to be excluded from the study due to various reasons (e.g. two samples from same tumor, samples from patients that did not fulfill inclusion criteria etc.).

FIG. 100 shows the disease-free survival of the total population in a Kaplan-Meier plot and FIG. 101 the distribution of follow-up times for the relapsed and censored patients in histograms. Table 5 lists the number of events broken down by different kinds of relapse. In summary, the survival of this population (82.1% after 10 years) is comparable to the expected one from the literature (79.2%).

DNA Extraction
DNA Extraction from Fresh Frozen Samples

From a total of 508 fresh frozen samples available as cell nuclei pellets, genomic DNA was isolated using the QIAamp Kit (Qiagen, Hilden, Germany). The extraction was done according to the Cell Culture protocol using Proteinase K with few modifications.

DNA Extraction from PET Samples 589 provided PET samples were deparaffinated directly in the tube in which they were delivered by the providers. The tissue was then lysed and DNA extracted using the QIAGEN DNeasy Tissue kit.

Bisulfite Treatment

Bisulfite treatment was carried out based on the method disclosed by Olek et al. Nucleic Acids Res. 1996 Dec. 15; 24(24):5064-6, and optimised to the applicant's laboratory workflow.

Quantification Standards

The reactions are calibrated by reference to DNA standards of known methylation levels in order to quantify the levels of methylation within the sample. The DNA standards were composed of bisulfite treated phi29 amplified human genomic DNA (Promega) (i.e. unmethylated), and/or phi29 amplified genomic DNA treated with Sss1 Methylase enzyme (thereby methylating each CpG position in the sample), which is then treated with bisulfite solution. Seven different reference standards were used with 0%, (i.e. phi29 amplified genomic DNA only), 5%, 10%, 25%, 50%, 75% and 100% (i.e. phi29 Sss1 treated genomic only).

2000 ng batches of human genomic DNA (Promega) were treated with bisulfite. To generate methylated MDA DNA, 13 tubes of 4.5 μg MDA-DNA (700 ng/μl) was treated with Sss1.

Control Assay

The GSTP1-C3 assay design makes it suitable for quantitating DNAs from different sources, including fresh/frozen samples, remote samples such as plasma or serum, and DNA obtained from archival specimen such as paraffin embedded material.

The following oligonucleotides were used in the reaction to amplify the control amplificate:

```
Control Primer1:
                                   (SEQ ID NO: 1095)
GGAGTGGAGGAAATTGAGAT Control Primer2:
                                   (SEQ ID NO: 1096)
CCACACAACAAATACTCAAAAC Control Probe:
                                   (SEQ ID NO: 1097)
FAM-TGGGTGTTTGTAATTTTTGTTTTGTGTTAGGTT-TAMRA
```

Cycle program (40 cycles): 95° C., 10 min; 95° C., 15 sec; 58° C., 1 min

Assay Design and Reaction Conditions

Two assays were developed for the analysis of the gene PITX2 (SEQ ID NO: 23)

```
Assay 1:
Primers:
                                   (SEQ ID NO: 1098)
GTAGGGGAGGGAAGTAGATGTT (SEQ ID NO: 1099)
TTCTAATCCTCCTTTCCACAATAA Probes:
                                   (SEQ ID NO: 1100)
FAM-AGTCGGAGTCGGGAGAGCGA-TAMRA (SEQ ID NO: 1101)
VIC-AGTTGGAGTTGGGAGAGTGAAAGGAGA-TAMRA
```

Amplicon:

GtAGGGGAGGGAAGtAGATGttAGCGGGtCGAAGAGTCGGGAGt-

CGGAGtCGGGAGAGCGAAAGGAGAGGGGAttTGGCGGGGt-

AtTTAGGAGttAAtCGAGGAGtAGGAGtACGGAtTtttAtTGTGGAAAGGAGGAttAGAA

Length of fragment: 143 bp

Positions of primers, probes and CpG dinucleotides are highlighted.

PCR components (supplied by Eurogentec): 3 mM MgCl2 buffer, 10× buffer, Hotstart TAQ, 200 μM dNTP, 625 nM each primer, 200 nM each probe Cycle program (45 cycles) 95° C., 10 min; 95° C., 15 sec; 62° C., 1 min Assay 2:

```
Primers:
AACATCTACTTCCCTCCCCTAC             (SEQ ID NO: 1102)

GTTAGTAGAGATTTTATTAAATTTTATTGTAT   (SEQ ID NO: 1103)
```

```
Probes:
FAM-TTCGGTTGCGCGGT-MGBNQF          (SEQ ID NO: 1104)

VIC-TTTGGTTGTGTGGTTG-MGBNQF        (SEQ ID NO: 1105)
```

Amplicon:

GTtAGtAGAGATTttAttAAAtTttAtTGtAtAGTGGCGCGCGGGCGGt-

CGGtCGAGttCGGtTGCGCGGtTGGCGATttAGGAGCGAGt-

AtAGCGtCGGGCGAGCGtCGGGGGGAGCGAGt-

AGGGGCGACGAGAAACGAGGtAGGGGAGGGAAGtAGATGtt

Length of fragment: 164 bp

The positions of probes, primers and CpG positions are highlighted.

The probes cover three co-methylated CpG positions.

PCR components (supplied by Eurogentec): 2.5 mM MgCl2 buffer, 10× buffer, Hotstart TAQ, 200 μM dNTP, 625 nM each primer, 200 nM each probe Program (45 cycles): 95° C., 10 min; 95° C., 15 sec; 60° C., 1 min The extent of methylation at a specific locus was determined by the following formulas:

Using absolute fluorescence intensity: methylation rate=$100*I(CG)/(I(CG)+I(TG))$ ($I$=Intensity of the fluorescence of $CG$-probe or $TG$-probe)

Using threshold cycle $Ct$: methylation rate=$100*CG/(CG+TG)=100/(1+TG/CG)=100/(1+2^{delta(ct)})$ (assuming PCR efficiency $E=2$; delta$(Ct)=Ct$(methylated)$-Ct$(unmethylated))

Gene PLAU (SEQ ID NO: 16)

```
Primer:
                                   (SEQ ID NO: 1106)
GTTAGGTGTATGGGAGGAAGTA (SEQ ID NO: 1107)
TCCCTCCCCTATCTTACAA Probes:
                                   (SEQ ID NO: 1108)
FAM-ACCCGAACCCCGCGTACTTC-TAMRA (SEQ ID NO: 1109)
VIC-ACCCAAACCCCACATACTTCCACA-TAMRA
```

Amplicon:

GttAGGTGtATGGGAGGAAGtACGGAGAATTTAtAAGttTtTCGATTtt-

TtAGTttAGACGtTGTTGGGTttttTtCGtTGGAGATCGCGtTTtttttAAATt-

TTTGTGAGCGTTGCGGAAGtACGCGGGGTtCGGGTCGtTGAGCGt-

TGtAAGAtAGGGGAGGGA

Length of fragment: 166 bp

The positions of probes, primers and CpG positions are highlighted.

PCR components were supplied by Eurogentec: 2.5 mM MgCl2 buffer, 10× buffer, Hotstart TAQ, 200 μM dNTP, 625 nM each primer, 200 nM each probe Program (45 cycles): 95° C., 10 min; 95° C., 15 sec; 60° C., 1 min Gene ONECUT2 (SEQ ID NO: 35)

Primer:
GTAGGAAGAGGTGTTGAGAAATTAA (SEQ ID NO: 1110)

CCACACAAAAAATTTCTATACTCCT (SEQ ID NO: 1111)

Probes:
FAM-ACGGGTAGAGGCGCGGGT-TAMRA (SEQ ID NO: 1112)

VIC-ATGGGTAGAGGTGTGGGTTATATTGTTTTG-TAMRA (SEQ ID NO: 1113)

Amplicon:

GtAGGAAGAGGTGtTGAGAAATTAAAAATTtAGGTTAGTTAATGt-
ATtttTGtCGtCGGtTGtAGGtTtCGttTTTGtATTAAGCGGGCGt-
TGATTGTGCGCGttTGGCGAtCGCGGGGAGGAtGGCGGtt-
CGCGGGAGGGGACGGGTAGAGGCGCGGGTTAtATTGTTtTG-
GAGtCGGtTCGGtTtTTTGTGttTttTtTAGCGGttAAGtTGCGAGGTAt-
AGtttTtTATTGTTtTAGGAGtAtAGAAAttTttTGTGTGG Length of fragment: 266 bp The positions of probes, primers and CpG positions are highlighted.

PCR components were supplied by Eurogentec: 3 mM MgCl2 buffer, 10× buffer, Hotstart TAQ, 200 μM dNTP, 625 nM each primer, 200 nM each probe Program (45 cycles): 95° C., 10 min; 95° C., 15 sec; 60° C., 1 min Gene ABCA8 (SEQ ID NO: 49)

Primer:
GTGAGGTATTGGATTTAGTTTATTTG (SEQ ID NO: 1114)

CCCTAAATCTCATCCTAAAAACAC (SEQ ID NO: 1115)

Probes:
FAM-TGAGGTTTCGGTTTTTAACGGTGG-TAMRA (SEQ ID NO: 1116)

VIC-TGAGGTTTTGGTTTTTAATGGTGGGAT-TAMRA (SEQ ID NO: 1117)

Amplicon:

GTGAGGTAtTGGATTtAGtttATTTGGtttCGAAGttTtTGTTt-
TCGGAATtCGGGTGtTGTGGGTTGAGGTttCGGTTtt-
TAACGGTGGGAtTGGTGTttTCGAGATGAAATTTGGGGTTTtt-
TCGGGGtTTTGGTGGGATCGGTGTttTtAGGATGAGArTTAGGG Length of fragment: 168 bp The positions of probes, primers and CpG positions are highlighted.

PCR components were supplied by Eurogentec: 3 mM MgCl2 buffer, 10× buffer, Hotstart TAQ, 200 μM dNTP, 625 nM each primer, 200 nM each probe Program (45 cycles): 95° C., 10 min; 95° C., 15 sec: 62° C., 1 min Gene ERBB2 (SEQ ID NO: 5)

Primer:
GGAGGGGGTAGAGTTATTAGTTTT (SEQ ID NO: 1118)

ACTCCCAACTTCACTTTCTCC (SEQ ID NO: 1119)

Probes:
FAM-TAATTTAGGCGTTTCGGCGTTAGG-TAMRA (SEQ ID NO: 1120)

VIC-TAATTTAGGTGTTTTGGTGTTAGGAGGGA-TAMRA (SEQ ID NO: 1121)

Amplicon:

GGAGGGGGTAGAGTTATTAGTTTTTGTATTTAGGGAT-
TTTTCGAGGAAAAGTGTGAGAACGGTTTGTAGGTAAT-
TTAGGCGTTTCGGCGTTAGGAGGGACGTATTTAGGTTT-
GCGCGAAGAGAGGGAGAAAGTGAAGTTGGGAGT

Length of fragment: 144 bp

The positions of probes, primers and CpG positions are highlighted.

PCR components were supplied by Eurogentec: 2.5 mM MgCl2 buffer, 10× buffer, Hotstart TAQ, 200 μM dNTP, 625 nM each primer, 200 nM each probe Program (45 cycles): 95° C., 10 min; 95° C., 15 sec; 62° C., 1 min Gene TFF1 (SEQ ID NO: 12)

Primer:
AGTTGGTGATGTTGATTAGAGTT (SEQ ID NO: 1122)
CCCTCCCAATATACAAATAAAAACTA (SEQ ID NO: 1123)

Probes:
FAM-ACACCGTTCGTAAAA-MGBNFQ (SEQ ID NO: 1124)
VIC-ACACCATTCATAAAAT-MGBNFQ (SEQ ID NO: 1125)

Amplicon:

AGTTGGTGATGTTGATTAnAGTTTTTGTAGTTTTAAATGAT-
TTTTTTAATTAATTTTAAATTTTTAGAATTTATCGTATAAA-
AAGGTTATATTTTTTGGAGGGACGTCGATGGTATTAGGAT-
AGAAGTATTAGGGGATTTTACGAACGGTGTCGTCGAAAT-
AGTAGTTTTTATrTGTATATTGGGAGGG

Length of fragment: 189 bp

The positions of probes, primers and CpG positions are highlighted.

PCR components were supplied by Eurogentec: 2.5 mM MgCl2 buffer, 10× buffer, Hotstart TAQ, 200 μM dNTP, 625 nM each primer, 200 nM each probe Program (45 cycles): 95° C., 10 min; 95° C., 15 sec; 60° C., 1 min Gene TBC1D3 (SEQ ID NO: 43)

Primer:
(SEQ ID NO: 1126)
TTTTTAGTTGGTTTTTATTAGGGTTTT (SEQ ID NO: 1127)
CCAACATATCCACCCACTTACT Probes:
(SEQ ID NO: 1128)
FAM-TTTCGACTAATCTCCCGCCGA-TAMRA (SEQ ID NO: 1129)
VIC-TTTCAACTAATCTCCCACCAAATTTACTATCA-TAMRA Amplicon:

tTTttAGtTGGtTtttAttAGGGtTttAGAGtttAAGAmAGtATt-

CGCGGGCGGtTtTGGGAAGttTGGtAGtTtCGtTAAtTttAAt-

ATGttTtATTTGAtAGtAAATTCGGCGGGAGATtAGt-

CGAAAGAGtAAQTGGGTQGATATGtTGG

Length of fragment: 142 bp

The positions of probes, primers and CpG positions are highlighted.

PCR components were supplied by Eurogentec: 4.5 mM MgCl2 buffer, 10× buffer, Hotstart TAQ, 200 μM dNTP, 625 nM each primer, 200 nM each probe Program (45 cycles): 95° C., 10 min; 95° C., 15 sec; 60° C., 1 min Each of the designed assays was tested on the following sets of samples:
Tamoxifen treated patients who relapsed during treatment (all relapses).
Tamoxifen treated patients who relapsed during treatment with distant metastases only.
Non-Tamoxifen treated patients who relapsed during treatment (all relapses).
Non-Tamoxifen treated patients who relapsed during treatment with distant metastases only.

Raw Data Processing

All analyses were based on CT evaluation (evaluation using fluorescence intensities are available upon request). Assuming optimal real-time PCR conditions in the exponential amplification phase, the concentration of methylated DNA ($C_{meth}$) can be determined by $$C_{meth} = \frac{100}{1 + 2^{(CT_{CG}-CT_{TG})}}[\%],$$

where
$CT_{CG}$ denotes the threshold cycle of the CG reporter (FAM channel) and
$CT_{TG}$ denotes the threshold cycle of the TG reporter (VIC channel).

The thresholds for the cycles were determined by human experts after a visual inspection of the Amplification Plots [ABI PRISM 7900 HT Sequence Detection System User Guide]. The values for the cycles ($CT_{CG}$ and $CT_{TG}$) were calculated with these thresholds by the ABI 7900 software. Whenever the amplification curve did not exceed the threshold, the value of the cycle was set to the maximum cycle, i.e. 50.

Statistical Methods
Cox Regression

The relation between disease-free survival times (DFS) (or metastasis free survival, MFS) and covariates are modeled using Cox Proportional Hazard models (Cox and Oates, 1984; Harrel, 2001).

The hazard, i.e. the instantaneous risk of a relapse, is modeled as $$h(t|x)=h_0(t)\cdot\exp(\beta x) \qquad (3)$$

and $$h(t|x_1,\ldots,x_k)=h_0(t)\cdot\exp(\beta_1 x_1+\ldots+\beta_k x_k) \qquad (4)$$

for univariate and multiple regression analyses, respectively, where t is the time measured in months after surgery, $h_0(t)$ is the baseline hazard, x is the vector of covariates (e.g. measurements of the assays) and β is the vector of regression coefficients (parameters of the model). β will be estimated by maximizing the partial likelihood of the Cox proportional hazard model Likelihood ratio tests are performed to test whether methylation is related to the hazard. The difference between −2 Log(Likelihood) of full model and null-model is approximately χ2-distributed with k degrees of freedom under the null hypotheses β1=...=βk=0. The assumption of proportional hazards were checked by scaled Schoenfeld residuals (Thernau et al., 2000). For the calculation, analysis and diagnostic of the Cox Proportional Hazard Model the R functions coxph, coxph.zph of the "survival" package were used.

Stepwise Regression Analysis

For multivariate Cox regression models a stepwise procedure (Venables et al., 1999; Harrel, 2001) was used in order to find sub-models including only relevant variables. Two effects are usually achieved by these procedures:
Variables (methylation rates) that are basically unrelated to the dependent variable (DFS/MFS) are excluded as they do not add relevant information to the model.
Out of a set of highly correlated variables, only the one with the best relation to the dependent variable is retained.
Inclusion of both types of variables can lead to numerical instabilities and a loss of power. Moreover, the predictory performance can be low due to overfitting.

The applied algorithm aims at minimizing the Akaike information criterion (AIC) which is defined as AIC=−2·maximized log–likelihood+2·#parameters.

The AIC is related to the predictory performance of a model, smaller values promise better performance. Whereas the inclusion of additional variables always improves the model fit and thus increases the likelihood, the second term penalizes the estimation of additional parameters. The best model will present a compromise model with good fit and usually a small or moderate number of variables. Stepwise regression calculation with AIC was done with the R function "step".

Kaplan-Meier Survival Curves and Log-Rank Tests

Survival curves are estimated from DFS/MFS data using the Kaplan-Meier method (Kaplan and Meier, 1958). Log-rank tests were used to test for differences of two survival curves, e.g. survival in hyper- vs. hypomethylated groups. For a description of this test see (Cox and Oates, 1984). For the Kaplan Meier Analysis the functions "survfit" and "survdiff" of the "survival" package were used.

Independence of Markers from Other Covariates

To check whether our marker panel gives additional and independent information, other relevant clinical factors were included in the cox proportional hazard model and the p-values for the weights for every factor were calculated (Wald-Test) (Thernau et al., 2000). For the analysis of additional factors in the Cox Proportional Hazard model, the R function "coxph" was used.

Correlation Analysis

Pearson and Spearman correlation coefficients are calculated to estimate the concordance between measurements (e.g. methylation in matched fresh frozen and PET samples).

Density Estimation

For numerical variables, kernel density estimation was performed with a gaussian kernel and variable bandwidth. The bandwidth is determined using Silverman's "rule-of-thumb" (Silverman, 1986). For the calculation of the densities the R function "density" was used.

Analysis of Sensitivity and Specificity

For the analysis of sensitivity and specificity of single assays and marker panels ROCs were calculated. The calculation of the ROCs was done with two methods: The first method is to calculate sensitivity and specificity for a given threshold for the time $T_{threshold}$. With that threshold, true positives, false positives, true negatives and false negatives were defined and the values for sensitivity and specificity were calculated for different cutoffs of the model. Patients censored before $T_{Threshold}$ were excluded. The ROCs were calculated for different times $T_{Threshold}$ (3 year, 4 years, . . . , 10 years). The second method is to calculate sensitivity and specificity by using the Bayes-formula based on the Kaplan-Meier estimates (Heagerty et al., 2000) for the survival probabilities in the marker positive and marker negative groups for a given time $T_{Threshold}$. The ROCs were calculated for different times $T_{Threshold}$ (3 year, 4 years, . . . , 10 years).

k-Fold Crossvalidation

For the analysis of model selection and model robustness k-fold crossvalidation (Hastie et al., 2001) was used. The set of observation was split in k chunks by random. In turn, every chunk was used as a test set and the remaining k-1 chunks were used as training set. This procedure was repeated n times.

Population Charts

For the description of the relation between censoring and a covariate Population Charts (Mocks et al., 2002) were used. The baseline of the covariate was calculated including all observations with event. For a given time t, the mean (in case of real variables like age) or the fraction (in case of categorical variables) for all censored patients in the risk set at time t was calculated and added to the baseline value.

Technical Performance

Comparison of Assay Replicates

Each marker was measured in at least three replicates, variability between assay replicates was observed to be higher for PET than for fresh frozen samples.

Concordance Study Fresh Frozen Versus PET Samples

Markers analyzed in this study (Example 2) were initially identified on a chip platform (Example 1) using fresh frozen samples. The ER+N0 untreated population was also analyzed on fresh frozen samples in Example 2. A concordance study should demonstrate that measured methylation ratios are comparable for fresh frozen and PET samples. For this purpose, 89 fresh frozen samples from three different providers already used in the chip study were processed again in parallel with a matching PET sample originating from the same tumor.

Figure 97:
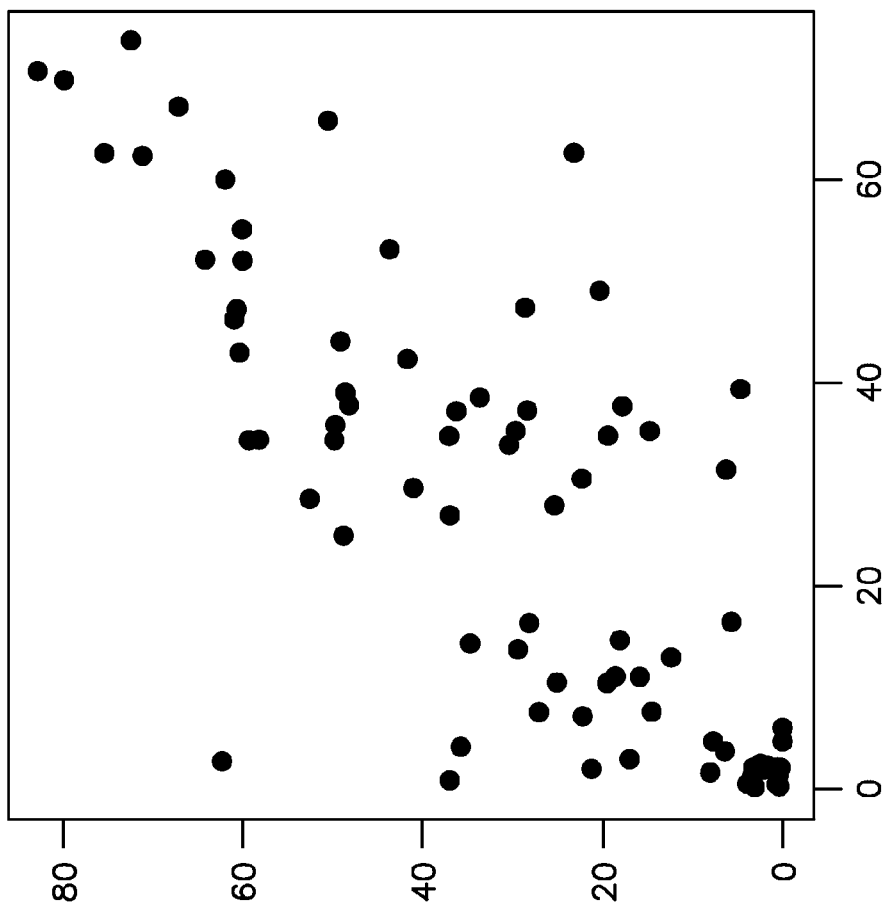
FIG. 97 shows a scatter plot of matched pair PET and fresh frozen tissues analysed using PITX2 gene assay 1 according to Example 2. Quantitative methylation CT scores of PET samples are shown on the Y-axis, and quantitative methylation CT scores of fresh frozen samples are shown on the X-axis. The association between the paired samples is 0.81 (Spearman's rho). This analysis is based on n=89 samples.

FIG. 97 shows such a concordance study for marker candidate PITX2 assay 1 as a scatter plot between fresh frozen and PET samples (using the QM assay). The association between the paired samples is 0.81 (Spearman's rho). This analysis is based on n=89 samples.

Results

Evaluation of Single Markers

Each of the eight established QM assays was used to measure the 508 samples from the N0, ER+ untreated patient population (random selection and additional relapses) in three replicates. After filtering of measuring points not fulfilling quality criteria and performing a Cox analyses, Kaplan-Meier survival curves and ROC curves for each single marker were generated.

Two different clinical endpoints were used for analyses:
Disease-free survival, i.e. using all kinds of relapses (distant metastasis, locoregional relapses, relapses at contralateral breast) as event.
Metastasis-free survival, i.e. treating only distant metastasis as an event.

For analyzing the ER+, N0, TAM treated population, five marker candidates were analyzed on 541 samples from the N0, ER+ untreated patient population. Assays were measured in three replicates. Three assays that were measured on the untreated population (PITX2-2, ONECUT, and ABCA8) were not measured due to the limited material that was available for the TAM treated population. These assays were rejected either because they performed bad in the untreated population (ONECUT2 and ABCA8) or in case of PITX2-II it performed significantly worse than the other assay of this marker (PITX2-I). After filtering of measuring points not fulfilling quality criteria Kaplan-Meier survival curves and ROC curves for each single marker were generated.

Two different clinical endpoints were used:
Disease-free survival, i.e. using all kinds of relapses (distant metastasis, locoregional relapses, relapses at contralateral breast) as event.
Metastasis-free survival, i.e. treating only distant metastasis as an event.

The Kaplan-Meier estimated disease-free survival or metastasis-free survival curves of each single assay are shown in FIGS. 55 to 80, and combinations of assays are shown in FIGS. 81 to 96. The X axis shows the disease free survival times of the patients in years, and the Y-axis shows the proportion of patients with disease free survival. The black plot shows the proportion of disease free patients in the population with above an optimised cut off point's methylation levels, the grey plot shows the proportion of disease free patients in the population with below an optimised cut off point's methylation levels.

The following p-values (probability that the observed distribution occurred by chance) were calculated when the cut off was optimised. For cut-off optimization, the quantiles of both groups were shifted between 0.2 and 0.8 and the p-value for the separation of the curves was calculated for each quantile. The quantile with the lowest p-value was then the best cut-off. Percentage values refer to the methylation ratios at the cut-off point.

Single Gene Assays

Tamoxifen Treated

TAM treated (all relapses) ERBB2 (SEQ ID NO: 5) (FIG. 55): p-value 0.089; cut off point: 1.3%

TAM treated (distant only) ERBB2 (SEQ ID NO: 5) (FIG. 56): p-value 0.084; cut off point: 0.1%

TAM treated (all relapses) TFF1 (SEQ ID NO: 12) (FIG. 57): p-value 0.037; cut off point: 50.9%

TAM treated (distant only) TFF1 (SEQ ID NO: 12) (FIG. 58): p-value 0.029; cut off point: 52.9%

TAM treated (all relapses) PLAU (SEQ ID NO:16) (FIG. 59): p-value 0.056; cut off point: 4.8%

TAM treated (distant only) PLAU (SEQ ID NO:16) (FIG. 60): p-value 0.065; cut off point: 4.8%
TAM treated (all relapses) PITX2 (SEQ ID NO:23) (FIG. 61): p-value 0.01; cut off point: 13.1%
TAM treated (distant only) PITX2 (SEQ ID NO:23) (FIG. 62): p-value 0.0012; cut off point: 14.3%
TAM treated (all relapses) TBC1D3 (SEQ ID NO: 43) (assay II) (FIG. 63): p-value 0.28; cut off point: 94.6%
TAM treated (distant only) TBC1D3 (SEQ ID NO: 43) (assay II) (FIG. 64): p-value 0.078; cut off point: 97%

FIG. 103 shows the ROC plot at different times for marker model PITX2 (Assay 1) alone on ER+N0 TAM treated population. FIG. A shows the plot at 60 months, FIG. B shows the plot at 72 months, FIG. C shows the plot at 84 months and FIG. D shows the plot at 96 months. Only distant metastasis are defined as events. Sensitivity (proportion of all relapsed patients in poor prognostic group) shown on the X-axis and specificity (proportion of all relapse free patients in good prognostic group) shown on the Y-axis are calculated from KM estimates, and the estimated area under the curve (AUC) is calculated. Values for median cut off (triangle) and best cut off (diamond, 0.42 quantile) are plotted.
AUC 60 months: 0.6
AUC 72 months: 0.69
AUC 84 months: 0.69
AUC 96 months: 0.67

FIG. 104 shows the ROC plot at different times for marker model TFF1 on ER+N0 TAM treated population. FIG. A shows the plot at 60 months, FIG. B shows the plot at 72 months, FIG. C shows the plot at 84 months and FIG. D shows the plot at 96 months. Only distant metastasis are defined as events. Sensitivity (proportion of all relapsed patients in poor prognostic group) shown on the X-axis and specificity (proportion of all relapse free patients in good prognostic group) shown on the Y-axis are calculated from KM estimates for different thresholds (=5, 6, 7, 8 years) and the estimated area under the curve (AUC) is calculated. Values for median cut off (triangle) and best cut off (diamond, 0.78 quantile) are plotted.
AUC 60 months: 0.7
AUC 72 months: 0.65
AUC 84 months: 0.61
AUC 96 months: 0.64

FIG. 105 shows the ROC plot at different times for marker model PLAU on ER+N0 TAM treated population. FIG. A shows the plot at 60 months, FIG. B shows the plot at 72 months, FIG. C shows the plot at 84 months and FIG. D shows the plot at 96 months. Only distant metastasis are defined as events. Sensitivity (proportion of all relapsed patients in poor prognostic group) shown on the X-axis and specificity (proportion of all relapse free patients in good prognostic group) shown on the Y-axis are calculated from KM estimates for different thresholds (=5, 6, 7, 8 years), and the estimated area under the curve (AUC) is calculated. Values for median cut off (triangle) and best cut off (diamond, 0.77 quantile) are plotted.
AUC 60 months: 0.6
AUC 72 months: 0.63
AUC 84 months: 0.57
AUC 96 months: 0.6

Non Tamoxifen Treated
Non Tamoxifen treated (all relapses) ERBB2 (SEQ ID NO: 5) (FIG. 65): p-value 0.21; cut off point: 0%
Non Tamoxifen treated (distant only) ERBB2 (SEQ ID NO: 5) (FIG. 66): p-value 0.23; cut off point: 0.6%
Non Tamoxifen treated (all relapses) TFF1 (SEQ ID NO: 12) (FIG. 67): p-value 0.012; cut off point: 49.6%
Non Tamoxifen treated (distant only) TFF1 (SEQ ID NO: 12) (FIG. 68): p-value 0.016; cut off point: 45.4%
Non Tamoxifen treated (all relapses) PLAU (SEQ ID NO:16) (FIG. 69): p-value 0.011; cut off point: 3.2%
Non Tamoxifen treated (distant only) PLAU (SEQ ID NO:16) (FIG. 70): p-value 0.0082; cut off point: 5.5%
Non Tamoxifen treated (all relapses) PITX2 (SEQ ID NO:23) (I) (FIG. 71): p-value 1.4e-06; cut off point: 35.4%
Non Tamoxifen treated (distant only) PITX2 (SEQ ID NO:23) (I) (FIG. 72): p-value 1.7 e-05; cut off point: 41.2%
Non Tamoxifen treated (all relapses) PITX2 (SEQ ID NO:23) (II) (FIG. 73): p-value 0.00026; cut off point: 56.1%
Non Tamoxifen treated (distant only) PITX2 (SEQ ID NO:23) (II) (FIG. 74): p-value 0.0026; cut off point: 61.9%
Non Tamoxifen treated (all relapses) ONECUT2 (SEQ ID NO:35) (FIG. 75): p-value 0.26; cut off point: 0%
Non Tamoxifen treated (distant only) ONECUT2 (SEQ ID NO:35) (FIG. 76): p-value 0.77; cut off point: 0%
Non Tamoxifen treated (all relapses) TBC1D3 (SEQ ID NO: 43) (FIG. 77): p-value 0.004; cut off point: 98.6%
Non Tamoxifen treated (distant only) TBC1D3 (SEQ ID NO: 43) (FIG. 78): p-value 0.00022; cut off point: 98.6%
Non Tamoxifen treated (all relapses) ABCA8 (SEQ ID NO: 49) (FIG. 79): p-value 0.0065; cut off point: 60.9%
Non Tamoxifen treated (distant only) ABCA8 (SEQ ID NO: 49) (FIG. 80): p-value 0.15; cut off point: 49.2%

Panels
Based on the results of the single marker evaluations, it was decided to build models using the marker candidates PITX2-Assay I, TFF1, and PLAU. All possible combinations of these markers were evaluated Tamoxifen Treated
TAM treated (all relapses) TFF1 (SEQ ID NO: 12) and PLAU (SEQ ID NO:16) (FIG. 81): p-value 0.023; cut off point: 0.7 quantile
TAM treated (distant only) TFF1 (SEQ ID NO: 12) and PLAU (SEQ ID NO:16) (FIG. 82): p-value 0.00084; cut off point: 0.72 quantile
TAM treated (all relapses) TFF1 (SEQ ID NO: 12) and PLAU (SEQ ID NO:16) and PITX2 (SEQ ID NO:23) (FIG. 83): p-value 0.037; cut off point: 0.72 quantile
TAM treated (distant only) TFF1 (SEQ ID NO: 12) and PLAU (SEQ ID NO:16) and PITX2 (SEQ ID NO:23) (FIG. 84): p-value 0.0014; cut off point: 0.4 quantile
TAM treated (all relapses) PITX2 (SEQ ID NO:23) and TFF1 (SEQ ID NO: 12) (FIG. 85): p-value 0.17; cut off point: 0.78 quantile
TAM treated (distant only) PITX2 (SEQ ID NO:23) and TFF1 (SEQ ID NO: 12) (FIG. 86): p-value 0.0048; cut off point: 0.32 quantile
TAM treated (all relapses) PITX2 (SEQ ID NO:23) and PLAU (SEQ ID NO:16) (FIG. 87): p-value 0.1; cut off point: 0.74 quantile
TAM treated (distant only) PITX2 (SEQ ID NO:23) and PLAU (SEQ ID NO:16) (FIG. 88): p-value 0.0081; cut off point: 0.44 quantile FIG. 102 shows the ROC plot at different times for marker model PITX2 (Assay 1) and TFF1 on ER+N0 TAM treated population. FIG. A shows the plot at 60 months, FIG. B shows the plot at 72 months, FIG. C shows the plot at 84 months and FIG. D shows the plot at 96 months. Only distant metastasis are defined as events. Sensitivity (proportion of all relapsed patients in poor prognostic group) shown on the X-axis and specificity (proportion of all relapse free patients in good prognostic group) shown on the Y-axis are calculated from KM estimates, and the estimated area under the curve (AUC)

is calculated. Values for median cut off (triangle) and best cut off (diamond, 0.32 quantile) are plotted.
AUC 60 months: 0.62
AUC 72 months: 0.67
AUC 84 months: 0.63
AUC 96 months: 0.65
Non Tamoxifen Treated
Non Tamoxifen treated (all relapses) TFF1 (SEQ ID NO: 12) and PLAU (SEQ ID NO:16) (FIG. 89): p-value 0.0015; cut off point: 0.78 quantile
Non Tamoxifen treated (distant only) TFF1 (SEQ ID NO: 12) and PLAU (SEQ ID NO:16) (FIG. 90): p-value 0.003; cut off point: 0.8 quantile
Non Tamoxifen treated (all relapses) TFF1 (SEQ ID NO: 12) and PLAU (SEQ ID NO:16) and PITX2 (SEQ ID NO:23) (FIG. 91): p-value 8.9e-07; cut off point: 0.64 quantile
Non Tamoxifen treated (distant only) TFF1 (SEQ ID NO: 12) and PLAU (SEQ ID NO:16) and PITX2 (SEQ ID NO:23) (FIG. 92): p-value 5.4e-05; cut off point: 0.66 quantile
Non Tamoxifen treated (all relapses) PITX2 (SEQ ID NO:23) and TFF1 (SEQ ID NO: 12) (FIG. 93): p-value 1.9e-06; cut off point: 0.72 quantile
Non Tamoxifen treated (distant only) PITX2 (SEQ ID NO:23) and TFF1 (SEQ ID NO: 12) (FIG. 94): p-value 3.5e-05; cut off point: 0.76 quantile
Non Tamoxifen treated (all relapses) PITX2 (SEQ ID NO:23) and PLAU (SEQ ID NO:16) (FIG. 95): p-value 1.1e-06; cut off point: 0.68 quantile
Non Tamoxifen treated (distant only) PITX2 (SEQ ID NO:23) and PLAU (SEQ ID NO:16) (FIG. 96): p-value 1.5e-05; cut off point: 0.64 quantile Robustness of Marker Models To evaluate the robustness of the models, a crossvalidation was performed on model marker panel PITX2 (Assay 1) plus TFF1 and marker panel PITX2 (Assay 1) alone, with 200 replicates. The stability of the assignment of one certain patient to the bad or good outcome group is illustrated in FIG. 106, the left hand figure shows model marker panel PITX2 (Assay 1) plus TFF1 and the right hand figure shows model marker panel PITX2 (Assay 1) alone. The plot illustrates in how many crossvalidation replicates each patient get's assigned to group 1 (light grey) or group 2 (dark grey).

FIG. 107 illustrates the amino acid sequence of the polypeptide encoded by the gene PITX2.

FIG. 108 illustrates the positions of the amplificates sequenced in Example 3. 'A' shows an illustration of the gene with the major exons annotated, 'B' shows annotated mRNA transcript variants and 'C' shows CpG rich regions of the gene. The positions of Amplificates 1 to 11 are shown to the right of the illustrations.

FIG. 109 shows the sequencing data of 11 amplificates of the gene PITX2 according to Example 3. Each column of the matrices of columns 'A' and 'B' represent the sequencing data for one amplificate. The amplificate number is shown to the left of the matrices. Each row of a matrix represents a single CpG site within the fragment and each column represents an individual DNA sample. The matrices in the column marked 'A' showed below median methylation as measured by QM assays, the matrices in the column marked 'B' showed below median methylation as measured by QM assays. The bar on the left represents a scale of the percent methylation, with the degree of methylation represented by the shade of each position within the column from black representing 100% methylation to light grey representing 0% methylation. White positions represented a measurement for which no data was available.

FIG. 110 shows a schematic view of mRNA transcript variants of PITX2, as annotated in the on-line Ensembl database.

EXAMPLE 3

Sequencing of Gene PITX2

Sequencing of the gene PITX2 was carried out in order to confirm that co-methylation of CpG positions correlated across all exons. For bisulfite sequencing amplification primers were designed to cover 11 sequences within the gene PITX2, see FIG. 108 for further details. Sixteen samples analysed in Example 4 were utilized for amplicon production. Each sample was treated with sodium bisulfite and sequenced. Sequence data was obtained using ABI 3700 sequencing technology. Obtained sequence traces were normalized and percentage methylation calculated using the Applicant's proprietary bisulphite sequence sequencing trace analysis program (See WO 2004/000463 for further information).

Samples

Eight samples displayed hypermethylation and eight samples displayed hypomethylation in analysis using QM assay II as described in example 2.

Amplification

Fragments of interest were amplified using the following conditions

PCR Reaction Solution:

| | |
|---|---|
| Taq 5 U/µl | 0.2 |
| dNTPs 25 mM each | 0.2 |
| 10x buffer | 2.5 |
| water | 10.1 |
| primer (6.25 µM) | 2 |
| DNA (1 ng/µl) | 10 |

Cycling Conditions:

| | |
|---|---|
| 15 min | 95° C. |
| 30 s | 95° C. |
| 30 s | 58° C. |
| 1:30 min | 72° C. |
| 40 cycles | |

Sequencing

Only G-rich primers were used for sequencing with one exception: Amplificate Number 2 was sequenced using both forward and reverse primer.

ExoSAP-IT Reaction Solution:

| |
|---|
| 4 µl PCR product + 2 µl ExoSAP-IT |
| 45 min/37° C. and 15 min/95° C. |

Cycle Sequencing:

| |
|---|
| 1 µl BigDye v.1.1 |
| 1 µl water |
| 4 µl Sanger buffer |
| 4 µl dNTP mix (0.025 mM each) |
| 10 µl |
| + |
| 5 µl Primer (2 pmol/µl) |
| + |
| 6 µl ExoSAP-IT product |

-continued

| Cycling |
|---|
| 2 min 96° C., 26 cycles a (30 s/96° C., 15 s/55° C., 4 min/60° C.) |

Purification

A 96 well MultiScreen (Millipore) plate was filled with Sephadex G50 (Amersham) using an appropriate admeasure device. 300 µl water were added to each well and incubated 3 h at 4° C. Water was removed by spinning for 5 minutes at 910 g. Cycle sequencing product was loaded to the plate and purified by spinning for 5 min at 910 g. 10 µl of formamide was added to each eluate.

Results:

All PCRs yielded a product. FIG. 109 provides matrices produced from bisulfite sequencing data analysed by the applicant's proprietary software (See WO 2004/000463 for further information). Each column of the matrices of columns 'A' and 'B' represent the sequencing data for one amplificate. The amplificate number is shown to the left of the matrices. Each row of a matrix represents a single CpG site within the fragment and each column represents an individual DNA sample. The matrices in the column marked 'A' showed below median methylation as measured by QM assays (see example 4), the matrices in the column marked 'B' showed below median methylation as measured by QM assays. The bar on the left represents a scale of the percent methylation, with the degree of methylation represented by the shade of each position within the column from black representing 100% methylation to light grey representing 0% methylation. White positions represented a measurement for which no data was available.

Bisulfite sequencing indicated differential methylation of CpG sites between the two selected classes of samples, furthermore co-methylation was observed across the gene. In particular amplificates 4 to 7 showed a high level of differential methylation between the two analysed groups.

TABLE 1

| Accession no. | Gene name/loci | Genomic SEQ ID NO: | Pretreated methylated sequence (sense) SEQ ID NO: | Pretreated methylated strand (antisense) SEQ ID NO: | Pretreated unmethylated sequence (sense) SEQ ID NO: | Pretreated unmethylated sequence (antisense) SEQ ID NO: |
|---|---|---|---|---|---|---|
| NM_001965 | EGR4 | 1 | 206 | 207 | 328 | 329 |
| NM_000038 | APC | 2 | 208 | 209 | 330 | 331 |
| NM_000077 | CDKN2A | 3 | 210 | 211 | 332 | 333 |
| NM_004385 | CSPG2 | 4 | 212 | 213 | 334 | 335 |
| NM_004448 | ERBB2 | 5 | 214 | 215 | 336 | 337 |
| NM_005563 | STMN1 | 6 | 216 | 217 | 338 | 339 |
| NM_000455 | STK11 | 7 | 218 | 219 | 340 | 341 |
| NM_001216 | CA9 | 8 | 220 | 221 | 342 | 343 |
| NM_001604 | PAX6 | 9 | 222 | 223 | 344 | 345 |
| NM_006142 | SFN | 10 | 224 | 225 | 346 | 347 |
| NM_005978 | S100A2 | 11 | 226 | 227 | 348 | 349 |
| NM_003225 | TFF1 | 12 | 228 | 229 | 350 | 351 |
| NM_003242 | TGFBR2 | 13 | 230 | 231 | 352 | 353 |
| NM_000546 | TP53 | 14 | 232 | 233 | 354 | 355 |
| NM_005427 | TP73 | 15 | 234 | 235 | 356 | 357 |
| NM_002658 | PLAU | 16 | 236 | 237 | 358 | 359 |
| NM_016192 | TMEFF2 | 17 | 238 | 239 | 360 | 361 |
| NM_000125 | ESR1 | 18 | 240 | 241 | 362 | 363 |
| NM_003177 | SYK | 19 | 242 | 243 | 364 | 365 |
| NM_001540 | HSPB1 | 20 | 244 | 245 | 366 | 367 |
| NM_007182 | RASSF1 | 21 | 246 | 247 | 368 | 369 |
| NM_015641 | TES | 22 | 248 | 249 | 370 | 371 |
| NM_000325 | PITX2 | 23 | 250 | 251 | 372 | 373 |
| NM_000836 | GRIN2D | 24 | 252 | 253 | 374 | 375 |
| NM_021154 | PSAT1 | 25 | 254 | 255 | 376 | 377 |
| NM_000735 | CGA | 26 | 256 | 257 | 378 | 379 |
| NM_000106 | CYP2D6 | 27 | 258 | 259 | 380 | 381 |
| NM_004718 | COX7A2L | 28 | 260 | 261 | 382 | 383 |
| NM_001437 | ESR2 | 29 | 262 | 263 | 384 | 385 |
| NM_002658 | PLAU | 30 | 264 | 265 | 386 | 387 |
| NM_000638 | VTN | 31 | 266 | 267 | 388 | 389 |
| NM_001055 | SULT1A1 | 32 | 268 | 269 | 390 | 391 |
| NM_003884 | PCAF | 33 | 270 | 271 | 392 | 393 |
| NM_006254 | PRKCD | 34 | 272 | 273 | 394 | 395 |
| NM_004852 | ONECUT2 | 35 | 274 | 275 | 396 | 397 |
| NM_001706 | BCL6 | 36 | 276 | 277 | 398 | 399 |
| NM_016312 | WBP11 | 37 | 278 | 279 | 400 | 401 |
| NM_002462 | MX1 | 38 | 280 | 281 | 402 | 403 |
| NM_138433 | MX1 | 39 | 282 | 283 | 404 | 405 |
| NM_000484 | APP | 40 | 284 | 285 | 406 | 407 |
| NM_002552 | ORC4L | 41 | 286 | 287 | 408 | 409 |
| NM_138999 | NETO1 | 42 | 288 | 289 | 410 | 411 |
| NM_032258 | TBC1D3 | 43 | 290 | 291 | 412 | 413 |
| NM_005310 | GRB7 | 44 | 292 | 293 | 414 | 415 |
| NM_000106 | CYP2D6 | 45 | 294 | 295 | 416 | 417 |
| NM_001259 | CDK6 | 46 | 296 | 297 | 418 | 419 |
| | Sequence located within Chr. 1p13.2 | 47 | 298 | 299 | 420 | 421 |

TABLE 1-continued

| Accession no. | Gene name/loci | Genomic SEQ ID NO: | Pretreated methylated sequence (sense) SEQ ID NO: | Pretreated methylated strand (antisense) SEQ ID NO: | Pretreated unmethylated sequence (sense) SEQ ID NO: | Pretreated unmethylated sequence (antisense) SEQ ID NO: |
|---|---|---|---|---|---|---|
| | Sequence located within Chr. 17q25.1 | 48 | 300 | 301 | 422 | 423 |
| NM__007168 | ABCA8 | 49 | 302 | 303 | 424 | 425 |
| | Sequence located within Chr. 12q14.3 | 50 | 304 | 305 | 426 | 427 |
| | Sequence located within Chr. 8q12.1 | 51 | 306 | 307 | 428 | 429 |
| NM__017490 | MARK2 | 52 | 308 | 309 | 430 | 431 |
| NM__005229 | ELK1 | 53 | 310 | 311 | 432 | 433 |
| | Q8WUT3 | 54 | 312 | 313 | 434 | 435 |
| NM__000737 | CGB | 55 | 314 | 315 | 436 | 437 |
| NM__001728 | BSG | 56 | 316 | 317 | 438 | 439 |
| NM__005881 | BCKDK | 57 | 318 | 319 | 440 | 441 |
| NM__014587 | SOX8 | 58 | 320 | 321 | 442 | 443 |
| NM__004393 | DAG1 | 59 | 322 | 323 | 444 | 445 |
| NM__020210 | SEMA4B | 60 | 324 | 325 | 446 | 447 |
| NM__000125 | ESR1 (exon8) | 61 | 204 | 327 | 448 | 449 |
| NM__000325 | PITX2 | 1130 | 1132 | 1133 | 1136 | 1137 |
| NM__003225 | TFF1 | 1131 | 1134 | 1135 | 1138 | 1139 |

TABLE 2

Primers and amplificates according to Example 1

| Gene: | Primer: | Amplificate Length: |
|---|---|---|
| EGR4 (SEQ ID NO: 1) | AGGGGGATTGAGTGTTAAGT (SEQ ID NO: 450) CCCAAACATAAACACAAAAT (SEQ ID NO: 451) | 294 |
| APC (SEQ ID NO: 2) | TCAACTACCATCAACTTCCT TA (SEQ ID NO: 452) AATTTATTTTTAGTGTTGTA GTGGG (SEQ ID NO: 453) | 491 |
| CDKN2A (SEQ ID NO: 3) | GGGGTTGGTTGGTTATTAGA (SEQ ID NO: 454) AACCCTCTACCCACCTAAAT (SEQ ID NO: 455) | 256 |
| CSPG2 (SEQ ID NO: 4) | GGATAGGAGTTGGGATTAAG AT (SEQ ID NO: 456) AAATCTTTTTCAACACCAAA AT (SEQ ID NO: 457) | 414 |
| ERBB2 (SEQ ID NO: 5) | GGAGGGGTAGAGTTATTAG TT (SEQ ID NO: 458) TATACTTCCTCAAACAACCC TC (SEQ ID NO: 459) | 257 |
| STMN1 (SEQ ID NO: 6) | GAGTTTGTATTTAAGTTGAG TGGTT (SEQ ID NO: 460) AACAAAACAATACCCCTTCT AA (SEQ ID NO: 461) | 334 |
| STMN1 (SEQ ID NO: 6) | CCTCTTACTAACCTCAACCA AC (SEQ ID NO: 463) GAAAGGTAGGGAAGGATTTT T (SEQ ID NO: 462) | 454 |
| STK11 (SEQ ID NO: 7) | TAAAAGAAGGATTTTTGATT GG (SEQ ID NO: 464) CATCTTATTTACCTCCCTCC C (SEQ ID NO: 465) | 528 |
| CA9 (SEQ ID NO: 8) | GGGAAGTAGGTTAGGGTTAG TT (SEQ ID NO: 466) AAATCCTCCTCTCCAAATAA AT (SEQ ID NO: 467) | |
| PAX6 (SEQ ID NO: 9) | GGAGGGGAGAGGGTTATG (SEQ ID NO: 468) TACTATACACACCCCAAAAC AA (SEQ ID NO: 469) | 374 |
| SFN (SEQ ID NO: 10) | GAAGAGAGGAGAGGGAGGTA (SEQ ID NO: 470) CTATCCAACAAACCCAACA (SEQ ID NO: 471) | 489 |
| S100A2 (SEQ ID NO: 11) | GTTTTTAAGTTGGAGAAGAG GA (SEQ ID NO: 472) ACCTATAAATCACAACCCAC TC (SEQ ID NO: 473) | 460 |

TABLE 2-continued

Primers and amplificates according to Example 1

| Gene: | Primer: | Amplificate Length: |
|---|---|---|
| TFF1 (SEQ ID NO: 12) | TTGGTGATGTTGATTAGAGT TT (SEQ ID NO: 474) TAAAACACCTTACATTTTCC CT (SEQ ID NO: 475) | 449 |
| TGFBR2 (SEQ ID NO: 13) | GTAATTTGAAGAAAGTTGAG GG (SEQ ID NO: 476) CCAACAACTAAACAAAACCT CT (SEQ ID NO: 477) | 296 |
| TP53 (SEQ ID NO: 14) | TTGATGAGAAGAAAGGATTT AGT (SEQ ID NO: 478) TCAAATTCAATCAAAAACTT ACC (SEQ ID NO: 479) | 496 |
| TP73 (SEQ ID NO: 15) | AGTAAATAGTGGGTGAGTTA TGAA (SEQ ID NO: 480) GAAAAACCTCTAAAAACTAC TCTCC (SEQ ID NO: 481) | 607 |
| PLAU (SEQ ID NO: 16) | GAGAGAGATAGTTGGGGAGT TT (SEQ ID NO: 482) CAAACAAACTTCATCTACCA AATAC (SEQ ID NO: 483) | 453 |
| TMEFF2 (SEQ ID NO: 17) | TGTTGGTTGTTGTTGTTGTT (SEQ ID NO: 484) CTTTCTACCCATCCCAAAA (SEQ ID NO: 485) | 319 |
| ESR1 (SEQ ID NO: 18) | CTATCAATTCCCCCAACTAC T (SEQ ID NO: 487) TTGTTGGATAGAGGTTGAGT TT (SEQ ID NO: 486) | 349 |
| SYK (SEQ ID NO: 19) | GTGGGTTTTGGGTAGTTATA GA (SEQ ID NO: 488) TAACCTCCTCTCCTTACCAA (SEQ ID NO: 489) | 485 |
| HSPB1 (SEQ ID NO: 20) | CCTACCTCTACCACTTCTCA AT (SEQ ID NO: 491) AAGAGGGTTTAGTTTTTATT TGG (SEQ ID NO: 490) | 216 |
| RASSF1 (SEQ ID NO:21) | AGTGGGTAGGTTAAGTGTGT TG (SEQ ID NO: 492) CCCCAAAATCCAAACTAAA (SEQ ID NO: 493) | 319 |
| TES (SEQ ID NO: 22) | AGGTTGGGGATTTTAGTTTT T (SEQ ID NO: 494) ACCTTCTTCACTTTATTTTC CA (SEQ ID NO: 495) | 448 |

TABLE 2-continued

Primers and amplificates according to Example 1

| Gene: | Primer: | Amplificate Length: |
|---|---|---|
| PITX2 (SEQ ID NO: 23) | TCCTCAACTCTACAAACCTA AAA (SEQ ID NO: 497) GTAGGGGAGGGAAGTAGATG T (SEQ ID NO: 496) | 408 |
| GRIN2D (SEQ ID NO: 24) | ATAGTTTGTGGTTTGGATTT TT (SEQ ID NO: 498) AAAACCTTTCCCTAACTTCA AT (SEQ ID NO: 499) | 435 |
| PSAT1 (SEQ ID NO: 25) | GTAGGTGGTTAATTTTGGGT T (SEQ ID NO: 500) CTCATTCACACTATATCCAT TCA (SEQ ID NO: 501) | 500 |
| PSAT1 (SEQ ID NO: 25) | TAAGAGAGAGGAGTTGAGGT TT (SEQ ID NO: 502) CCAAAATTAACCACCTACCT AA (SEQ ID NO: 503) | 478 |
| CGA (SEQ ID NO: 26) | TAGTGGTATAAGTTTGGAAA TGTT (SEQ ID NO: 504) TCCACCTACATCTAAACCCT AA (SEQ ID NO: 505) | 364 |
| CYP2D6 (SEQ ID NO: 27) | CCTCCTAAACTAAATCCAAC AA (SEQ ID NO: 507) GGGGTTAAGGTTTTTATGGT A (SEQ ID NO: 506) | 418 |
| COX7A2L (SEQ ID NO: 28) | AATCCTAAAAACCCTAACTT TTAAT (SEQ ID NO: 509) GGAGGTGTAAGGAGAATAGA GA (SEQ ID NO: 508) | 398 |
| ESR2 (SEQ ID NO: 29) | AAACCTTCCCAATAACCTCT TA (SEQ ID NO: 511) TAGAGGGGAGTAGTGTTTGA GT (SEQ ID NO: 510) | 471 |
| PLAU (SEQ ID NO: 30) | GTGATATTTGGGGATTGTTA TT (SEQ ID NO: 512) ACTCCCTCCCCTATCTTACA (SEQ ID NO: 513) 479 | 479 |
| VTN (SEQ ID NO: 31) | GTTATTTGGGTTAATGTAGG GA (SEQ ID NO: 514) TCTATCCCCTCAAACTTAAA AA (SEQ ID NO: 515) | 492 |
| SULT1A1 (SEQ ID NO: 32) | ATACTACCAAACCCACTCAA AC (SEQ ID NO: 517) GAATTTAGGGAAGGAGTTAG TTG (SEQ ID NO: 516) | 448 |

TABLE 2-continued

Primers and amplificates according to Example 1

| Gene: | Primer: | Amplificate Length: |
|---|---|---|
| PCAF (SEQ ID NO: 33) | GGATAAATGATTGAGAGGTT GT (SEQ ID NO: 518) CCTCCCTTAATTCTCCTACC (SEQ ID NO: 519) | 369 |
| PRKCD (SEQ ID NO: 34) | CTTAACCCATCCCAATCA (SEQ ID NO: 521) GATAGAAGGATTTTAGTTTT TATTGTT (SEQ ID NO: 520) | 322 |
| ONECUT2 (SEQ ID NO: 35) | TTTGTTGGGATTTGTTAGGA T (SEQ ID NO: 522) AAACATTTTACCCCTCTAAA CC (SEQ ID NO: 523) | 467 |
| BCL6 (SEQ ID NO: 36) | CATCACCACTTCTAAAAACC C (SEQ ID NO: 525) GGGTAAGAAAGAAGGAATTA GTTT (SEQ ID NO: 524) | 456 |
| WBP11 (SEQ ID NO: 37) | AAGAGGTGAGGAAGAGTAGT AAAT (SEQ ID NO: 526) CTCCCAACAACTAAATCAAA AT (SEQ ID NO: 527) | 437 |
| MX1 (SEQ ID NO: 38) | TGTAGGAGAGGTTGGGAAG (SEQ ID NO: 528) CCAAACATAACATCCACTAA AA (SEQ ID NO: 529) | 341 |
| MX1 (SEQ ID NO: 39) | TAGGTTTAAGAGGAGAGGGA AT (SEQ ID NO: 530) AAACAACTACCCAAATCCAA C (SEQ ID NO: 531) | 433 |
| APP (SEQ ID NO: 40) | GAGTAAGGAAGGGGGATG (SEQ ID NO: 532) AACCCAAATCTTTAATACAA AAA (SEQ ID NO: 533) | 494 |
| NETO1 (SEQ ID NO: 42) | GGAGTTTTTAGAAGAGGAAG ATT (SEQ ID NO: 534) ACTTCACAATAAATACCCTC CC (SEQ ID NO: 535) | 395 |
| TBC1D3 (SEQ ID NO: 43) | GGTAGAGGAAGTAGTTGGTT TG (SEQ ID NO: 536) CTTTTATATTTCTCCCAATC TCC (SEQ ID NO: 537) | 490 |
| GRB7 (SEQ ID NO: 44) | AAAATCCATAACCACCAAAA TA (SEQ ID NO: 539) TTAGGAAGTTTTAGGAATGA GG (SEQ ID NO: 538) | 416 |

TABLE 2-continued

Primers and amplificates according to Example 1

| Gene: | Primer: | Amplificate Length: |
|---|---|---|
| CYP2D6 (SEQ ID NO: 45) | AATTTCCTAACCCACTATCC TC (SEQ ID NO: 541) ATTTGTAGTTTGGGGTGATT T (SEQ ID NO: 540) | 379 |
| CDK6 (SEQ ID NO: 46) | ACCTTAAACACCTTCCCATA A (SEQ ID NO: 543) GTGTAATGATTTTGGATTGA GA (SEQ ID NO: 542) | 456 |
| SEQ ID NO: 47 | AAGGAAGGTAGAGGGTTGAG T (SEQ ID NO: 544) AAAATCCAAAATTAACACCA TT (SEQ ID NO: 545) | 499 |
| SEQ ID NO: 48 | AGTAGATGAAGTTGGGGATT AG (SEQ ID NO: 546) TCCTACTATCCCTTCTCAAA AA (SEQ ID NO: 547) | 500 |
| ABCA8 (SEQ ID NO: 49) | TGATTGTGTAGATTATTTTT GGTT (SEQ ID NO: 548) CAAACTCTCTAAACCTCAAT CTC (SEQ ID NO: 549) | 499 |
| SEQ ID NO: 50 | ACCCTAACATTCTCTAAACA ACA (SEQ ID NO: 551) GATGAAAGTGGAAAGATTAT GG (SEQ ID NO: 550) | 441 |
| SEQ ID NO: 51 | CTCCAACTCTCCTCACCTC (SEQ ID NO: 553) ATTTGAAGGTTGTGTTTGTA GA (SEQ ID NO: 552) | 343 |
| MARK2 (SEQ ID NO: 52) | TCACCACTATCCTCAATAAT CA (SEQ ID NO: 555) TAAAGTAGGAAGGTTTGGTT TG (SEQ ID NO: 554) | 476 |
| ELK1 (SEQ ID NO: 53) | CCTCTAATTCCTATCAATCA CC (SEQ ID NO: 557) TTAGAAGTGAAAGTAGAAGG GTTT (SEQ ID NO: 556) | 435 |
| Q8WUT3 (SEQ ID NO: 54) | GGTTAGAAGTTAGAGGGGTA GG (SEQ ID NO: 558) CCATCCCATTACCTATAAAA AT (SEQ ID NO: 559) | 406 |
| CGB (SEQ ID NO: 55) | TCCACCCTATTTTCTACCAA (SEQ ID NO: 561) TTTGTTTTAGGTGGTGTGTA AT (SEQ ID NO: 560) | 417 |

TABLE 2-continued

Primers and amplificates according to Example 1

| Gene: | Primer: | Amplificate Length: |
|---|---|---|
| BSG (SEQ ID NO: 56) | TTATCTATCCCCACACCCTA AT (SEQ ID NO: 563) GGAGTAGGTGAGGAGTATTT TG (SEQ ID NO: 562) | 420 |
| BCKDK (SEQ ID NO: 57) | TCACCTCCTTTTACAACCAA T (SEQ ID NO: 565) TTTGGGAGAGTTTTAGGATT TA (SEQ ID NO: 564) | 258 |
| SOX8 (SEQ ID NO: 58) | GGGTGGGTAGTAGGTTTGTT (SEQ ID NO: 566) ACACACTCCTTAAAACTCTT CC (SEQ ID NO: 567) | 435 |
| DAG1 (SEQ ID NO: 59) | AATACCAACCCAAACATCTA CC (SEQ ID NO: 569) TTTGGTTATGTGGAGTTTAT TGT (SEQ ID NO: 568) | |
| ORC4L (SEQ ID NO: 41) | CACTCAAAACTTCCCTACCT AC (SEQ ID NO: 571) GGTAATGGTGGGGGTAAAT (SEQ ID NO: 570) | 489 |
| SEMA4B (SEQ ID NO: 60) | ACCAAAATACTACTCCCAAA TC (SEQ ID NO: 573) GGGTAGAGGGAGGTTATTGT T (SEQ ID NO: 572) | 337 |
| ESR1 (exon8) (SEQ ID NO: 61) | TATGATTTGTTGTTGGAGAT GT (SEQ ID NO: 574) CTTAAAATCCCTTTAACTAT TCCC (SEQ ID NO: 575) | 388 |

TABLE 3

Hybridisation oligonucleotides according to Example 1

| Gene | | Oligo: | |
|---|---|---|---|
| ONECUT2 | (SEQ ID NO: 35) | TACGTAGTTGCGCGTT | (SEQ ID NO: 800) |
| ONECUT2 | (SEQ ID NO: 35) | GTATGTAGTTGTGTGTT | (SEQ ID NO: 801) |
| ONECUT2 | (SEQ ID NO: 35) | TTTTGTGCGTACGGAT | (SEQ ID NO: 802) |
| ONECUT2 | (SEQ ID NO: 35) | TTTTTGTGTGTATGGAT | (SEQ ID NO: 803) |
| ONECUT2 | (SEQ ID NO: 35) | TTAAGCGGGCGTTGAT | (SEQ ID NO: 804) |
| ONECUT2 | (SEQ ID NO: 35) | TTAAGTGGGTGTTGAT | (SEQ ID NO: 805) |
| ONECUT2 | (SEQ ID NO: 35) | TAGAGGCGCGGGTTAT | (SEQ ID NO: 806) |
| ONECUT2 | (SEQ ID NO: 35) | TAGAGGTGTGGGTTAT | (SEQ ID NO: 807) |
| BCL6 | (SEQ ID NO: 36) | ATTTCGAAATATGTCGG | (SEQ ID NO: 1004) |
| BCL6 | (SEQ ID NO: 36) | ATTTTGAAATATGTTGGT | (SEQ ID NO: 1005) |
| BCL6 | (SEQ ID NO: 36) | ATTCGAGACGTTTTGT | (SEQ ID NO: 1006) |
| BCL6 | (SEQ ID NO: 36) | TTTGAGATGTTTTGTTTA | (SEQ ID NO: 1007) |
| BCL6 | (SEQ ID NO: 36) | TTCGAGTTTCGAATCGG | (SEQ ID NO: 1008) |
| BCL6 | (SEQ ID NO: 36) | TTTGAGTTTTGAATTGGA | (SEQ ID NO: 1009) |
| BCL6 | (SEQ ID NO: 36) | ATAGCGAAGGCGTCGA | (SEQ ID NO: 1010) |
| BCL6 | (SEQ ID NO: 36) | TATAGTGAAGGTGTTGA | (SEQ ID NO: 1011) |
| WBP11 | (SEQ ID NO: 37) | TTACGAGAAGCGGGTA | (SEQ ID NO: 946) |
| WBP11 | (SEQ ID NO: 37) | ATTATGAGAAGTGGGTA | (SEQ ID NO: 947) |
| WBP11 | (SEQ ID NO: 37) | AGGGGGCGATTTTCGG | (SEQ ID NO: 948) |
| WBP11 | (SEQ ID NO: 37) | TAGGGGGTGATTTTTGG | (SEQ ID NO: 949) |
| WBP11 | (SEQ ID NO: 37) | TTAGCGTCGTTTGATT | (SEQ ID NO: 950) |

TABLE 3-continued

Hybridisation oligonucleotides according to Example 1

| Gene | | Oligo: | |
|---|---|---|---|
| WBP11 | (SEQ ID NO: 37) | TTTTAGTGTTGTTTGATT | (SEQ ID NO: 951) |
| WBP11 | (SEQ ID NO: 37) | AGTTCGTTTTATTGCGT | (SEQ ID NO: 952) |
| WBP11 | (SEQ ID NO: 37) | GAGTTTGTTTTATTGTGT | (SEQ ID NO: 953) |
| MX1 | (SEQ ID NO: 38) | AACGCGCGAAAGTAAA | (SEQ ID NO: 576) |
| MX1 | (SEQ ID NO: 38) | TTGGGAATGTGTGAAA | (SEQ ID NO: 577) |
| MX1 | (SEQ ID NO: 38) | TTCGAGTTGGGTCGAGA | (SEQ ID NO: 578) |
| MX1 | (SEQ ID NO: 38) | TTTGAGTTGGGTTGAGA | (SEQ ID NO: 579) |
| MX1 | (SEQ ID NO: 38) | TATGCGCGGAAGATT | (SEQ ID NO: 580) |
| MX1 | (SEQ ID NO: 38) | GTATGTGTGGGAGAT | (SEQ ID NO: 581) |
| MX1 | (SEQ ID NO: 38) | ATTTACGGTTGCGCGG | (SEQ ID NO: 582) |
| MX1 | (SEQ ID NO: 38) | TATGGTTGTGTGGGTTA | (SEQ ID NO: 583) |
| MX1 | (SEQ ID NO: 39) | AGGCGTTTATAGTCGGT | (SEQ ID NO: 584) |
| MX1 | (SEQ ID NO: 39) | AGGTGTTTATAGTTGGT | (SEQ ID NO: 585) |
| MX1 | (SEQ ID NO: 39) | TTTCGAGTTCGGAGTA | (SEQ ID NO: 586) |
| MX1 | (SEQ ID NO: 39) | TTTTGAGTTTGGAGTAG | (SEQ ID NO: 587) |
| MX1 | (SEQ ID NO: 39) | TTGTCGGTCGTAGCGG | (SEQ ID NO: 588) |
| MX1 | (SEQ ID NO: 39) | TTTGTTGGTTGTAGTGG | (SEQ ID NO: 589) |
| MX1 | (SEQ ID NO: 39) | TTCGTTACGGCGGTAG | (SEQ ID NO: 590) |
| MX1 | (SEQ ID NO: 39) | AGTTTGTTATGGTGGT | (SEQ ID NO: 591) |
| APP | (SEQ ID NO: 40) | TGAAACGAGGCGGAGA | (SEQ ID NO: 592) |
| APP | (SEQ ID NO: 40) | TGAAATGAGGTGGAGA | (SEQ ID NO: 593) |
| APP | (SEQ ID NO: 40) | GACGTTGCGTTTTCGG | (SEQ ID NO: 594) |
| APP | (SEQ ID NO: 40) | GGATGTTGTGTTTTTGG | (SEQ ID NO: 595) |
| APP | (SEQ ID NO: 40) | TTTTTAGCGGGTCGGA | (SEQ ID NO: 596) |
| APP | (SEQ ID NO: 40) | TTTTTAGTGGGTTGGA | (SEQ ID NO: 597) |
| APP | (SEQ ID NO: 40) | GGACGTTCGTAAGCGG | (SEQ ID NO: 598) |
| APP | (SEQ ID NO: 40) | GGATGTTTGTAAGTGG | (SEQ ID NO: 599) |
| ORC4L | (SEQ ID NO: 41) | TTATACGCGTTGTTTAT | (SEQ ID NO: 600) |
| ORC4L | (SEQ ID NO: 41) | TGTATTATATGTGTTGTTT | (SEQ ID NO: 601) |
| ORC4L | (SEQ ID NO: 41) | AGCGTGACGGTTCGAG | (SEQ ID NO: 602) |
| ORC4L | (SEQ ID NO: 41) | AGTGTGATGGTTTGAG | (SEQ ID NO: 603) |
| ORC4L | (SEQ ID NO: 41) | ATTAGGCGAGTTTCGT | (SEQ ID NO: 604) |
| ORC4L | (SEQ ID NO: 41) | TTAGGTGAGTTTTGTTT | (SEQ ID NO: 605) |
| NETO1 | (SEQ ID NO: 42) | TACGTTCGGTTTTACGA | (SEQ ID NO: 606) |
| NETO1 | (SEQ ID NO: 42) | TTATGTTTGGTTTTATGAT | (SEQ ID NO: 607) |
| NETO1 | (SEQ ID NO: 42) | TTACGTCGGTTTCGAT | (SEQ ID NO: 608) |
| NETO1 | (SEQ ID NO: 42) | TTTATGTTGGTTTTGATT | (SEQ ID NO: 609) |
| NETO1 | (SEQ ID NO: 42) | TTCGGTTTCGGGAAAG | (SEQ ID NO: 610) |

TABLE 3-continued

Hybridisation oligonucleotides according to Example 1

| Gene | | Oligo: | |
|---|---|---|---|
| NETO1 | (SEQ ID NO: 42) | TTTGGTTTTGGGAAAGG | (SEQ ID NO: 611) |
| NETO1 | (SEQ ID NO: 42) | TGTCGTACGTGTTTAT | (SEQ ID NO: 612) |
| NETO1 | (SEQ ID NO: 42) | AATTTTTGTTGTATGTGT | (SEQ ID NO: 613) |
| TBC1D3 | (SEQ ID NO: 43) | TATTCGCGGGCGGTTT | (SEQ ID NO: 988) |
| TBC1D3 | (SEQ ID NO: 43) | TAGTATTTGTGGGTGG | (SEQ ID NO: 989) |
| TBC1D3 | (SEQ ID NO: 43) | ATTCGGCGGGAGATTA | (SEQ ID NO: 990) |
| TBC1D3 | (SEQ ID NO: 43) | AGTAAATTTGGTGGGA | (SEQ ID NO: 991) |
| TBC1D3 | (SEQ ID NO: 43) | AGATTAGTCGAAAGAGT | (SEQ ID NO: 992) |
| TBC1D3 | (SEQ ID NO: 43) | GAGATTAGTTGAAAGAGT | (SEQ ID NO: 993) |
| TBC1D3 | (SEQ ID NO: 43) | TATATTTCGGGGTTTTAA | (SEQ ID NO: 994) |
| TBC1D3 | (SEQ ID NO: 43) | TATATTTTGGGGTTTTAAA | (SEQ ID NO: 995) |
| GRB7 | (SEQ ID NO: 44) | ATAGTTTCGTTATTTGTAT | (SEQ ID NO: 1062) |
| GRB7 | (SEQ ID NO: 44) | GGTATAGTTTTGTTATTTG | (SEQ ID NO: 1063) |
| GRB7 | (SEQ ID NO: 44) | TTTAGTACGGGGTGTA | (SEQ ID NO: 1064) |
| GRB7 | (SEQ ID NO: 44) | TTTTAGTATGGGGTGTA | (SEQ ID NO: 1065) |
| GRB7 | (SEQ ID NO: 44) | GGCGTTATAGTTACGTTT | (SEQ ID NO: 1066) |
| GRB7 | (SEQ ID NO: 44) | GGGTGTTATAGTTATGTT | (SEQ ID NO: 1067) |
| GRB7 | (SEQ ID NO: 44) | TGTTTATCGAAGGTAGA | (SEQ ID NO: 1068) |
| GRB7 | (SEQ ID NO: 44) | TGTTTATTGAAGGTAGAA | (SEQ ID NO: 1069) |
| CYP2D6 | (SEQ ID NO: 45) | GAGATCGCGTTTTCGT | (SEQ ID NO: 844) |
| CYP2D6 | (SEQ ID NO: 45) | AGAGATTGTGTTTTTGT | (SEQ ID NO: 845) |
| CYP2D6 | (SEQ ID NO: 45) | ATTCGCGGCGAGGATA | (SEQ ID NO: 846) |
| CYP2D6 | (SEQ ID NO: 45) | GATTTGTGGTGAGGAT | (SEQ ID NO: 847) |
| CYP2D6 | (SEQ ID NO: 45) | GTCGTTTCGGGGACGT | (SEQ ID NO: 848) |
| CYP2D6 | (SEQ ID NO: 45) | GTTGTTTTGGGGATGTG | (SEQ ID NO: 849) |
| CYP2D6 | (SEQ ID NO: 45) | TAAGTAGCGTCGATAG | (SEQ ID NO: 850) |
| CYP2D6 | (SEQ ID NO: 45) | AAGTAGTGTTGATAGGG | (SEQ ID NO: 851) |
| CDK6 | (SEQ ID NO: 46) | TACGAATGCGTGGCGG | (SEQ ID NO: 866) |
| CDK6 | (SEQ ID NO: 46) | TATGAATGTGTGGTGGA | (SEQ ID NO: 867) |
| CDK6 | (SEQ ID NO: 46) | TTTCGGAGTAGGCGAG | (SEQ ID NO: 868) |
| CDK6 | (SEQ ID NO: 46) | TTTTGGAGTAGGTGAG | (SEQ ID NO: 869) |
| CDK6 | (SEQ ID NO: 46) | TACGTTAGTTTCGCGG | (SEQ ID NO: 870) |
| CDK6 | (SEQ ID NO: 46) | TATGTTAGTTTTGTGGG | (SEQ ID NO: 871) |
| CDK6 | (SEQ ID NO: 46) | ATTGAGACGCGTTTGG | (SEQ ID NO: 872) |
| CDK6 | (SEQ ID NO: 46) | GAGATGTGTTTGGGTA | (SEQ ID NO: 873) |
| SEQ ID NO: 47 | (SEQ ID NO: 47) | TAAATTCGACGGGTTT | (SEQ ID NO: 1054) |
| SEQ ID NO: 47 | (SEQ ID NO: 47) | ATTTGATGGGTTTTTGT | (SEQ ID NO: 1055) |
| SEQ ID NO: 47 | (SEQ ID NO: 47) | TTTTCGTTCGGCGGAG | (SEQ ID NO: 1056) |

TABLE 3-continued

Hybridisation oligonucleotides according to Example 1

| Gene | | Oligo: | |
|---|---|---|---|
| SEQ ID NO: 47 | (SEQ ID NO: 47) | TTTGTTTGGTGGAGGTT | (SEQ ID NO: 1057) |
| SEQ ID NO: 47 | (SEQ ID NO: 47) | TTCGCGTTTATCGTGT | (SEQ ID NO: 1058) |
| SEQ ID NO: 47 | (SEQ ID NO: 47) | TGGTTTGTGTTTATTGT | (SEQ ID NO: 1059) |
| SEQ ID NO: 47 | (SEQ ID NO: 47) | TTTCGCGGTTCGTAGT | (SEQ ID NO: 1060) |
| SEQ ID NO: 47 | (SEQ ID NO: 47) | TTTGTGGTTTGTAGTTTA | (SEQ ID NO: 1061) |
| SEQ ID NO: 48 | (SEQ ID NO: 48) | TTAGGTCGGGAGGAAA | (SEQ ID NO: 614) |
| SEQ ID NO: 48 | (SEQ ID NO: 48) | TTAGGTTGGGAGGAAA | (SEQ ID NO: 615) |
| SEQ ID NO: 48 | (SEQ ID NO: 48) | TTAGACGTGGGGCGAT | (SEQ ID NO: 616) |
| SEQ ID NO: 48 | (SEQ ID NO: 48) | TTAGATGTGGGGTGAT | (SEQ ID NO: 617) |
| SEQ ID NO: 48 | (SEQ ID NO: 48) | TAAGGTACGAGCGTGT | (SEQ ID NO: 618) |
| SEQ ID NO: 48 | (SEQ ID NO: 48) | AAGGTATGAGTGTGTG | (SEQ ID NO: 619) |
| SEQ ID NO: 48 | (SEQ ID NO: 48) | GTAGAGTACGAGAGATT | (SEQ ID NO: 620) |
| SEQ ID NO: 48 | (SEQ ID NO: 48) | GGTAGAGTATGAGAGAT | (SEQ ID NO: 621) |
| ABCA8 | (SEQ ID NO: 49) | ATTTGGTTTCGAAGTTT | (SEQ ID NO: 996) |
| ABCA8 | (SEQ ID NO: 49) | TATTTGGTTTTGAAGTTT | (SEQ ID NO: 997) |
| ABCA8 | (SEQ ID NO: 49) | TTTTCGGAATTCGGGT | (SEQ ID NO: 998) |
| ABCA8 | (SEQ ID NO: 49) | TTTTGGAATTTGGGTGT | (SEQ ID NO: 999) |
| ABCA8 | (SEQ ID NO: 49) | TTTCGGTTTTTAACGGT | (SEQ ID NO: 1000) |
| ABCA8 | (SEQ ID NO: 49) | TTTTGGTTTTTAATGGTG | (SEQ ID NO: 1001) |
| ABCA8 | (SEQ ID NO: 49) | AAAATTTACGAGGGGA | (SEQ ID NO: 1002) |
| ABCA8 | (SEQ ID NO: 49) | TTAAAATTTATGAGGGGA | (SEQ ID NO: 1003) |
| SEQ ID NO: 50 | (SEQ ID NO: 50) | ATGACGATGATTGGCGA | (SEQ ID NO: 622) |
| SEQ ID NO: 50 | (SEQ ID NO: 50) | GATGATGATTGGTGAGT | (SEQ ID NO: 623) |
| SEQ ID NO: 50 | (SEQ ID NO: 50) | TTATGACGTTTAATCGT | (SEQ ID NO: 624) |
| SEQ ID NO: 50 | (SEQ ID NO: 50) | AGTTATGATGTTTAATTGT | (SEQ ID NO: 625) |
| SEQ ID NO: 50 | (SEQ ID NO: 50) | AATCGAACGTTGGCGT | (SEQ ID NO: 626) |
| SEQ ID NO: 50 | (SEQ ID NO: 50) | AAATTGAATGTTGGTGT | (SEQ ID NO: 627) |
| SEQ ID NO: 51 | (SEQ ID NO: 51) | TATTCGGGTTTCGCGA | (SEQ ID NO: 1070) |
| SEQ ID NO: 51 | (SEQ ID NO: 51) | ATTTGGTTTTGTGAG | (SEQ ID NO: 1071) |
| SEQ ID NO: 51 | (SEQ ID NO: 51) | TATTGTTACGCGTCGA | (SEQ ID NO: 1072) |
| SEQ ID NO: 51 | (SEQ ID NO: 51) | ATTGTTATGTGTTGATTT | (SEQ ID NO: 1073) |
| SEQ ID NO: 51 | (SEQ ID NO: 51) | GACGTGTAGGTCGTAT | (SEQ ID NO: 1074) |
| SEQ ID NO: 51 | (SEQ ID NO: 51) | GATGTGTAGGTTGTATT | (SEQ ID NO: 1075) |
| SEQ ID NO: 51 | (SEQ ID NO: 51) | TTCGGGAACGATTTTT | (SEQ ID NO: 1076) |
| SEQ ID NO: 51 | (SEQ ID NO: 51) | GGGTTTGGGAATGATT | (SEQ ID NO: 1077) |
| MARK2 | (SEQ ID NO: 52) | ATATTTCGGGGAAGT | (SEQ ID NO: 628) |
| MARK2 | (SEQ ID NO: 52) | TATATTTTGGGGAAGT | (SEQ ID NO: 629) |
| MARK2 | (SEQ ID NO: 52) | TTTCGTATTTGTCGGA | (SEQ ID NO: 630) |

TABLE 3-continued

Hybridisation oligonucleotides according to Example 1

| Gene | | Oligo: | |
|---|---|---|---|
| MARK2 | (SEQ ID NO: 52) | TTTGTATTTGTTGGAGT | (SEQ ID NO: 631) |
| MARK2 | (SEQ ID NO: 52) | GGTTATATCGTAGGGTA | (SEQ ID NO: 632) |
| MARK2 | (SEQ ID NO: 52) | GGGTTATATTGTAGGGT | (SEQ ID NO: 633) |
| MARK2 | (SEQ ID NO: 52) | AGGGGGACGAATTAGG | (SEQ ID NO: 634) |
| MARK2 | (SEQ ID NO: 52) | GAGGGGGATGAATTAG | (SEQ ID NO: 635) |
| ELK1 | (SEQ ID NO: 53) | GGTCGGCGTTGATTTTA | (SEQ ID NO: 920) |
| ELK1 | (SEQ ID NO: 53) | GGTTGGTGTTGATTTTA | (SEQ ID NO: 921) |
| ELK1 | (SEQ ID NO: 53) | GTCGGGATTCGAACGG | (SEQ ID NO: 922) |
| ELK1 | (SEQ ID NO: 53) | GTTGGGATTTGAATGG | (SEQ ID NO: 923) |
| ELK1 | (SEQ ID NO: 53) | GTCGGAAGTTTCGGGA | (SEQ ID NO: 924) |
| ELK1 | (SEQ ID NO: 53) | GTTGGAAGTTTTGGGAT | (SEQ ID NO: 925) |
| ELK1 | (SEQ ID NO: 53) | ATATCGTAGGGTAGGCGG | (SEQ ID NO: 926) |
| ELK1 | (SEQ ID NO: 53) | ATATTGTAGGGTAGGTGG | (SEQ ID NO: 927) |
| Q8WUT3 | (SEQ ID NO: 54) | TAGAACGGCGTGGGAT | (SEQ ID NO: 636) |
| Q8WUT3 | (SEQ ID NO: 54) | TAGAATGGTGTGGGAT | (SEQ ID NO: 637) |
| Q8WUT3 | (SEQ ID NO: 54) | GTCGCGATGTAGTTACGT | (SEQ ID NO: 638) |
| Q8WUT3 | (SEQ ID NO: 54) | GTTGTGATGTAGTTATGT | (SEQ ID NO: 639) |
| Q8WUT3 | (SEQ ID NO: 54) | TTAGTTTCGGGATCGG | (SEQ ID NO: 640) |
| Q8WUT3 | (SEQ ID NO: 54) | TTTAGTTTTGGGATTGG | (SEQ ID NO: 641) |
| Q8WUT3 | (SEQ ID NO: 54) | TTCGTTTTTCGGGATA | (SEQ ID NO: 642) |
| Q8WUT3 | (SEQ ID NO: 54) | TTTGTTTTTTGGGATAAA | (SEQ ID NO: 643) |
| CGB | (SEQ ID NO: 55) | TTACGTCGTGGTTTTTA | (SEQ ID NO: 954) |
| CGB | (SEQ ID NO: 55) | TTATGTTGTGGTTTTTAG | (SEQ ID NO: 955) |
| CGB | (SEQ ID NO: 55) | GGCGTGAATTTCGTGG | (SEQ ID NO: 956) |
| CGB | (SEQ ID NO: 55) | GGTGTGAATTTTGTGGT | (SEQ ID NO: 957) |
| CGB | (SEQ ID NO: 55) | TTTCGAGTTTATTCGGT | (SEQ ID NO: 958) |
| CGB | (SEQ ID NO: 55) | TTTTGAGTTTATTTGGTT | (SEQ ID NO: 959) |
| CGB | (SEQ ID NO: 55) | TTATCGCGATGTGCGT | (SEQ ID NO: 960) |
| CGB | (SEQ ID NO: 55) | ATTATTGTGATGTGTGT | (SEQ ID NO: 961) |
| BSG | (SEQ ID NO: 56) | TACGGTTCGCGTTGTT | (SEQ ID NO: 644) |
| BSG | (SEQ ID NO: 56) | GGAGTATGGTTTGTGT | (SEQ ID NO: 645) |
| BSG | (SEQ ID NO: 56) | GTAAGGTTCGGCGAGA | (SEQ ID NO: 646) |
| BSG | (SEQ ID NO: 56) | GTAAGGTTTGGTGAGA | (SEQ ID NO: 647) |
| BSG | (SEQ ID NO: 56) | TTACGTTTTCGGGAAG | (SEQ ID NO: 648) |
| BSG | (SEQ ID NO: 56) | TTATGTTTTTGGGAAGG | (SEQ ID NO: 649) |
| BSG | (SEQ ID NO: 56) | TACGTTTCGAGGATCGG | (SEQ ID NO: 650) |
| BSG | (SEQ ID NO: 56) | TATGTTTTGAGGATTGG | (SEQ ID NO: 651) |
| BCKDK | (SEQ ID NO: 57) | GGGCGTTAGGCGGATT | (SEQ ID NO: 652) |

TABLE 3-continued

Hybridisation oligonucleotides according to Example 1

| Gene | | Oligo: | |
|---|---|---|---|
| BCKDK | (SEQ ID NO: 57) | TGGGTGTTAGGTGGAT | (SEQ ID NO: 653) |
| BCKDK | (SEQ ID NO: 57) | AGAGCGGTTAGCGTAG | (SEQ ID NO: 654) |
| BCKDK | (SEQ ID NO: 57) | TGAGAGTGGTTAGTGT | (SEQ ID NO: 655) |
| BCKDK | (SEQ ID NO: 57) | ATAGAGGGCGTGAATT | (SEQ ID NO: 656) |
| BCKDK | (SEQ ID NO: 57) | AGAGGGTGTGAATTTT | (SEQ ID NO: 657) |
| BCKDK | (SEQ ID NO: 57) | TAGGATTTACGAGGAAA | (SEQ ID NO: 658) |
| BCKDK | (SEQ ID NO: 57) | AGGATTTATGAGGAAAAT | (SEQ ID NO: 659) |
| SOX8 | (SEQ ID NO: 58) | TTTTCGGTTCGAAGTA | (SEQ ID NO: 660) |
| SOX8 | (SEQ ID NO: 58) | TTTTGGTTTGAAGTAGG | (SEQ ID NO: 661) |
| SOX8 | (SEQ ID NO: 58) | AGGTCGTTTTATCGA | (SEQ ID NO: 662) |
| SOX8 | (SEQ ID NO: 58) | AGGTTGTTTTATTGAGT | (SEQ ID NO: 663) |
| SOX8 | (SEQ ID NO: 58) | GTAGTTACGGGGCGTT | (SEQ ID NO: 664) |
| SOX8 | (SEQ ID NO: 58) | GTAGTTATGGGGTGTT | (SEQ ID NO: 665) |
| SOX8 | (SEQ ID NO: 58) | TGTCGTATAGGCGGTT | (SEQ ID NO: 666) |
| SOX8 | (SEQ ID NO: 58) | TTGTTGTATAGGTGGTT | (SEQ ID NO: 667) |
| DAG1 | (SEQ ID NO: 59) | TTTCGTGGCGGAGAAT | (SEQ ID NO: 820) |
| DAG1 | (SEQ ID NO: 59) | TTTTGTGGTGGAGAAT | (SEQ ID NO: 821) |
| DAG1 | (SEQ ID NO: 59) | TACGGATATTTCGGTT | (SEQ ID NO: 822) |
| DAG1 | (SEQ ID NO: 59) | AATTATGGATATTTTGGTT | (SEQ ID NO: 823) |
| DAG1 | (SEQ ID NO: 59) | TTACGATTCGTAGGTT | (SEQ ID NO: 824) |
| DAG1 | (SEQ ID NO: 59) | TATTATTATGATTTGTAGGT | (SEQ ID NO: 825) |
| SEMA4B | (SEQ ID NO: 60) | AGTTTTGGGCGCGATTT | (SEQ ID NO: 668) |
| SEMA4B | (SEQ ID NO: 60) | AGTTTTGGGTGTGATTT | (SEQ ID NO: 669) |
| SEMA4B | (SEQ ID NO: 60) | AGCGAATAGATTGCGGAT | (SEQ ID NO: 670) |
| SEMA4B | (SEQ ID NO: 60) | AGTGAATAGATTGTGGAT | (SEQ ID NO: 671) |
| SEMA4B | (SEQ ID NO: 60) | AGCGATTAGATTGCGGAT | (SEQ ID NO: 672) |
| SEMA4B | (SEQ ID NO: 60) | AGTGATTAGATTGTGGAT | (SEQ ID NO: 673) |
| SEMA4B | (SEQ ID NO: 60) | TAGGCGTTCGATTTTT | (SEQ ID NO: 674) |
| SEMA4B | (SEQ ID NO: 60) | GGGTAGGTGTTTGATT | (SEQ ID NO: 675) |
| APC | (SEQ ID NO: 2) | GGTTTCGTTTAATCGT | (SEQ ID NO: 928) |
| APC | (SEQ ID NO: 2) | GGGTTTTGTTTAATTGTA | (SEQ ID NO: 929) |
| APC | (SEQ ID NO: 2) | TTCGTATTTAGCGGAT | (SEQ ID NO: 930) |
| APC | (SEQ ID NO: 2) | GGTTTGTATTTAGTGGA | (SEQ ID NO: 931) |
| APC | (SEQ ID NO: 2) | ATCGGCGGGTTTTCGA | (SEQ ID NO: 932) |
| APC | (SEQ ID NO: 2) | ATTGGTGGGTTTTTGA | (SEQ ID NO: 933) |
| APC | (SEQ ID NO: 2) | ATTTTCGAGTTCGGTA | (SEQ ID NO: 934) |
| APC | (SEQ ID NO: 2) | TTTTTGAGTTTGGTAGT | (SEQ ID NO: 935) |
| CDKN2A | (SEQ ID NO: 3) | GGCGTTGTTTAACGTAT | (SEQ ID NO: 676) |

TABLE 3-continued

Hybridisation oligonucleotides according to Example 1

| Gene | | Oligo: | |
|---|---|---|---|
| CDKN2A | (SEQ ID NO: 3) | GGGTGTTGTTTAATGTA | (SEQ ID NO: 677) |
| CDKN2A | (SEQ ID NO: 3) | AACGTATCGAATAGTTACGG | (SEQ ID NO: 678) |
| CDKN2A | (SEQ ID NO: 3) | AATGTATTGAATAGTTATGG | (SEQ ID NO: 679) |
| CDKN2A | (SEQ ID NO: 3) | TACGGTCGGAGGTCGA | (SEQ ID NO: 680) |
| CDKN2A | (SEQ ID NO: 3) | TATGGTTGGAGGTTGA | (SEQ ID NO: 681) |
| CSPG2 | (SEQ ID NO: 4) | TTCGGTTAGTTTCGTAT | (SEQ ID NO: 904) |
| CSPG2 | (SEQ ID NO: 4) | TTTTGGTTAGTTTTGTATT | (SEQ ID NO: 905) |
| CSPG2 | (SEQ ID NO: 4) | TTCGGGTTATTACGTTT | (SEQ ID NO: 906) |
| CSPG2 | (SEQ ID NO: 4) | TTTTGGGTTATTATGTTTT | (SEQ ID NO: 907) |
| CSPG2 | (SEQ ID NO: 4) | TTTAGTCGCGTAGCGT | (SEQ ID NO: 908) |
| CSPG2 | (SEQ ID NO: 4) | ATTTAGTTGTGTAGTGTT | (SEQ ID NO: 909) |
| CSPG2 | (SEQ ID NO: 4) | AATTCGCGAGTTTAGA | (SEQ ID NO: 910) |
| CSPG2 | (SEQ ID NO: 4) | GAAAAAAATTTGTGAGTT | (SEQ ID NO: 911) |
| ERBB2 | (SEQ ID NO: 5) | TGTGAGAACGGTTGTA | (SEQ ID NO: 912) |
| ERBB2 | (SEQ ID NO: 5) | TGAGAATGGTTGTAGG | (SEQ ID NO: 913) |
| ERBB2 | (SEQ ID NO: 5) | TTAGGCGTTTCGGCGT | (SEQ ID NO: 914) |
| ERBB2 | (SEQ ID NO: 5) | TTTAGGTGTTTTGGTGT | (SEQ ID NO: 915) |
| ERBB2 | (SEQ ID NO: 5) | TAGGTTTGCGCGAAGA | (SEQ ID NO: 916) |
| ERBB2 | (SEQ ID NO: 5) | TTTGTGTGAAGAGAGG | (SEQ ID NO: 917) |
| ERBB2 | (SEQ ID NO: 5) | TAATTATCGGAGAAGGA | (SEQ ID NO: 918) |
| ERBB2 | (SEQ ID NO: 5) | TAATTATTGGAGAAGGAG | (SEQ ID NO: 919) |
| STMN1 | (SEQ ID NO: 6) | TTAGGCGGTTCGGATT | (SEQ ID NO: 1012) |
| STMN1 | (SEQ ID NO: 6) | TTAGGTGGTTTGGATT | (SEQ ID NO: 1013) |
| STMN1 | (SEQ ID NO: 6) | TATCGGTTCGGGAATT | (SEQ ID NO: 1014) |
| STMN1 | (SEQ ID NO: 6) | TATTGGTTTGGGAATTT | (SEQ ID NO: 1015) |
| STMN1 | (SEQ ID NO: 6) | TTTCGCGCGGAGGTTA | (SEQ ID NO: 1016) |
| STMN1 | (SEQ ID NO: 6) | TTTTGTGTGGAGGTTA | (SEQ ID NO: 1017) |
| STMN1 | (SEQ ID NO: 6) | GGTAAGAACGTATATAGT | (SEQ ID NO: 1018) |
| STMN1 | (SEQ ID NO: 6) | TGGTAAGAATGTATATAGT | (SEQ ID NO: 1019) |
| STMN1 | (SEQ ID NO: 6) | TTTCGGTTAATGCGGA | (SEQ ID NO: 1020) |
| STMN1 | (SEQ ID NO: 6) | TTTTTGGTTAATGTGGA | (SEQ ID NO: 1021) |
| STMN1 | (SEQ ID NO: 6) | TACGTTCGCGATTTGT | (SEQ ID NO: 1022) |
| STMN1 | (SEQ ID NO: 6) | AGGGTTATGTTTGTGA | (SEQ ID NO: 1023) |
| STMN1 | (SEQ ID NO: 6) | GATACGTCGGTGTCGG | (SEQ ID NO: 1024) |
| STMN1 | (SEQ ID NO: 6) | TGATATGTTGGTGTTGG | (SEQ ID NO: 1025) |
| STMN1 | (SEQ ID NO: 6) | TTACGGCGAGATTATT | (SEQ ID NO: 1026) |
| STMN1 | (SEQ ID NO: 6) | TTTTATGGTGAGATTATTT | (SEQ ID NO: 1027) |
| STK11 | (SEQ ID NO: 7) | ATTAATCGTCGTTCGG | (SEQ ID NO: 880) |

TABLE 3-continued

Hybridisation oligonucleotides according to Example 1

| Gene | | Oligo: | |
|---|---|---|---|
| STK11 | (SEQ ID NO: 7) | GATTAATTGTTGTTTGGG | (SEQ ID NO: 881) |
| STK11 | (SEQ ID NO: 7) | TAATCGTTAGCGGCGG | (SEQ ID NO: 882) |
| STK11 | (SEQ ID NO: 7) | TTAATTGTTAGTGGTGG | (SEQ ID NO: 883) |
| STK11 | (SEQ ID NO: 7) | GTCGTTTTCGCGAGGA | (SEQ ID NO: 884) |
| STK11 | (SEQ ID NO: 7) | GTTGTTTTTGTGAGGAG | (SEQ ID NO: 885) |
| STK11 | (SEQ ID NO: 7) | TAATGAGCGCGTTGTA | (SEQ ID NO: 886) |
| STK11 | (SEQ ID NO: 7) | ATGAGTGTGTTGTATTT | (SEQ ID NO: 887) |
| CA9 | (SEQ ID NO: 8) | ATGGTTTCGATAATTTTT | (SEQ ID NO: 682) |
| CA9 | (SEQ ID NO: 8) | ATGGTTTTGATAATTTTTT | (SEQ ID NO: 683) |
| CA9 | (SEQ ID NO: 8) | TGTACGTATAGTTCGTA | (SEQ ID NO: 684) |
| CA9 | (SEQ ID NO: 8) | TTAATGTATGTATAGTTTGT | (SEQ ID NO: 685) |
| CA9 | (SEQ ID NO: 8) | ATATATCGTGTGTTGGG | (SEQ ID NO: 686) |
| CA9 | (SEQ ID NO: 8) | ATATATTGTGTGTTGGG | (SEQ ID NO: 687) |
| CA9 | (SEQ ID NO: 8) | ATAGTTAGTCGTATGGT | (SEQ ID NO: 688) |
| CA9 | (SEQ ID NO: 8) | ATAGTTAGTTGTATGGTT | (SEQ ID NO: 689) |
| PAX6 | (SEQ ID NO: 9) | TATTGTTTCGGTTGTTAG | (SEQ ID NO: 690) |
| PAX6 | (SEQ ID NO: 9) | TATTGTTTTGGTTGTTAG | (SEQ ID NO: 691) |
| PAX6 | (SEQ ID NO: 9) | GGCGACGCGGTTAGTT | (SEQ ID NO: 692) |
| PAX6 | (SEQ ID NO: 9) | GGTGATGTGGTTAGTT | (SEQ ID NO: 693) |
| PAX6 | (SEQ ID NO: 9) | TAGGTCGCGTAGATTT | (SEQ ID NO: 694) |
| PAX6 | (SEQ ID NO: 9) | AGTTTAGGTTGTGTAGA | (SEQ ID NO: 695) |
| PAX6 | (SEQ ID NO: 9) | TAGCGTATTTTTCGGT | (SEQ ID NO: 696) |
| PAX6 | (SEQ ID NO: 9) | TAGTGTATTTTTTGGTTG | (SEQ ID NO: 697) |
| SFN | (SEQ ID NO: 10) | AGTAGGTCGAACGTTA | (SEQ ID NO: 698) |
| SFN | (SEQ ID NO: 10) | AGAGTAGGTTGAATGTT | (SEQ ID NO: 699) |
| SFN | (SEQ ID NO: 10) | TTGCGAAGAGCGAAAT | (SEQ ID NO: 700) |
| SFN | (SEQ ID NO: 10) | TGTGAAGAGTGAAATTT | (SEQ ID NO: 701) |
| SFN | (SEQ ID NO: 10) | TTCGAGGTGCGTGAGT | (SEQ ID NO: 702) |
| SFN | (SEQ ID NO: 10) | TTTGAGGTGTGTGAGTA | (SEQ ID NO: 703) |
| SFN | (SEQ ID NO: 10) | TGTGCGATATCGTGTT | (SEQ ID NO: 704) |
| SFN | (SEQ ID NO: 10) | TGTGATATTGTGTTGGG | (SEQ ID NO: 705) |
| S100A2 | (SEQ ID NO: 11) | TTTAATTGCGGTTGTGTG | (SEQ ID NO: 786) |
| S100A2 | (SEQ ID NO: 11) | TTTAATTGTGGTTGTGTG | (SEQ ID NO: 787) |
| S100A2 | (SEQ ID NO: 11) | TATATAGGCGTATGTATG | (SEQ ID NO: 788) |
| S100A2 | (SEQ ID NO: 11) | TATATAGGTGTATGTATG | (SEQ ID NO: 789) |
| S100A2 | (SEQ ID NO: 11) | TGTATACGAGTATTGGA | (SEQ ID NO: 790) |
| S100A2 | (SEQ ID NO: 11) | TATGTATATGAGTATTGGA | (SEQ ID NO: 791) |
| S100A2 | (SEQ ID NO: 11) | AGTTTTAGCGTGTGTTTA | (SEQ ID NO: 792) |

TABLE 3-continued

Hybridisation oligonucleotides according to Example 1

| Gene | | Oligo: | |
|---|---|---|---|
| S100A2 | (SEQ ID NO: 11) | AGTTTTAGTGTGTGTTTA | (SEQ ID NO: 793) |
| TFF1 | (SEQ ID NO: 12) | AGAATTTATCGTATAAAAAG | (SEQ ID NO: 794) |
| TFF1 | (SEQ ID NO: 12) | AATTTATTGTATAAAAAGGT | (SEQ ID NO: 795) |
| TFF1 | (SEQ ID NO: 12) | GGACGTCGATGGTATT | (SEQ ID NO: 796) |
| TFF1 | (SEQ ID NO: 12) | AGGGATGTTGATGGTA | (SEQ ID NO: 797) |
| TFF1 | (SEQ ID NO: 12) | AACGGTGTCGTCGAAA | (SEQ ID NO: 798) |
| TFF1 | (SEQ ID NO: 12) | AATGGTGTTGTTGAAAT | (SEQ ID NO: 799) |
| TGFBR2 | (SEQ ID NO: 13) | AAAACGTGGACGTTTT | (SEQ ID NO: 896) |
| TGFBR2 | (SEQ ID NO: 13) | GAAAATGTGGATGTTTT | (SEQ ID NO: 897) |
| TGFBR2 | (SEQ ID NO: 13) | TGAAAGTCGGTTAAAGT | (SEQ ID NO: 898) |
| TGFBR2 | (SEQ ID NO: 13) | TGAAAGTTGGTTAAAGT | (SEQ ID NO: 899) |
| TGFBR2 | (SEQ ID NO: 13) | TTGGACGTCGAGGAGA | (SEQ ID NO: 900) |
| TGFBR2 | (SEQ ID NO: 13) | TTGGATGTTGAGGAGA | (SEQ ID NO: 901) |
| TGFBR2 | (SEQ ID NO: 13) | TTTTCGGGCGGAGAGA | (SEQ ID NO: 902) |
| TGFBR2 | (SEQ ID NO: 13) | AAGGTTTTTGGGTGGA | (SEQ ID NO: 903) |
| TP53 | (SEQ ID NO: 14) | TATTAGGTCGGCGAGA | (SEQ ID NO: 858) |
| TP53 | (SEQ ID NO: 14) | AGGTTGGTGAGAATTT | (SEQ ID NO: 859) |
| TP53 | (SEQ ID NO: 14) | TTCGGTAGGCGGATTA | (SEQ ID NO: 860) |
| TP53 | (SEQ ID NO: 14) | TTTTTGGTAGGTGGAT | (SEQ ID NO: 861) |
| TP53 | (SEQ ID NO: 14) | ATATTTTGCGTTCGGG | (SEQ ID NO: 862) |
| TP53 | (SEQ ID NO: 14) | ATATTTTGTGTTTGGGT | (SEQ ID NO: 863) |
| TP53 | (SEQ ID NO: 14) | TACGACGGTGATACGT | (SEQ ID NO: 864) |
| TP53 | (SEQ ID NO: 14) | TTTATGATGGTGATATGT | (SEQ ID NO: 865) |
| TP73 | (SEQ ID NO: 15) | TTCGTTCGCGAAGTTA | (SEQ ID NO: 706) |
| TP73 | (SEQ ID NO: 15) | GGTTTGTTTGTGAAGTTA | (SEQ ID NO: 707) |
| PLAU | (SEQ ID NO: 16) | AAGAGGTCGTCGGGAT | (SEQ ID NO: 708) |
| PLAU | (SEQ ID NO: 16) | AAGAGGTTGTTGGGAT | (SEQ ID NO: 709) |
| PLAU | (SEQ ID NO: 16) | TTATCGCGGGTATTTT | (SEQ ID NO: 710) |
| PLAU | (SEQ ID NO: 16) | TTGGTTATTGTGGGTAT | (SEQ ID NO: 711) |
| PLAU | (SEQ ID NO: 16) | TTCGATTTCGTTATTATG | (SEQ ID NO: 712) |
| PLAU | (SEQ ID NO: 16) | TTTGATTTTGTTATTATGAG | (SEQ ID NO: 713) |
| PLAU | (SEQ ID NO: 16) | GTCGTGAGCGATTTTA | (SEQ ID NO: 714) |
| PLAU | (SEQ ID NO: 16) | TTGGTTGTGAGTGATT | (SEQ ID NO: 715) |
| TMEFF2 | (SEQ ID NO: 17) | TATCGTAGTTCGTTCGG | (SEQ ID NO: 874) |
| TMEFF2 | (SEQ ID NO: 17) | ATTGTAGTTTGTTTGGT | (SEQ ID NO: 875) |
| TMEFF2 | (SEQ ID NO: 17) | AAACGTTTATCGGTTG | (SEQ ID NO: 876) |
| TMEFF2 | (SEQ ID NO: 17) | AATGTTTATTGGTTGGA | (SEQ ID NO: 877) |
| TMEFF2 | (SEQ ID NO: 17) | TTCGTAGAAGAATACGCGTA | (SEQ ID NO: 878) |

TABLE 3-continued

Hybridisation oligonucleotides according to Example 1

| Gene | | Oligo: | |
|---|---|---|---|
| TMEFF2 | (SEQ ID NO: 17) | TTTGTAGAAGAATATGTGTA | (SEQ ID NO: 879) |
| ESR1 | (SEQ ID NO: 18) | TGCGGTTGTATACGTAG | (SEQ ID NO: 962) |
| ESR1 | (SEQ ID NO: 18) | TGTGTGGTTGTATATGT | (SEQ ID NO: 963) |
| ESR1 | (SEQ ID NO: 18) | TTCGTGTTAGATTTCGATAT | (SEQ ID NO: 964) |
| ESR1 | (SEQ ID NO: 18) | TTTGTGTTAGATTTTGATAT | (SEQ ID NO: 965) |
| ESR1 | (SEQ ID NO: 18) | AACGCGAAAGACGGAT | (SEQ ID NO: 966) |
| ESR1 | (SEQ ID NO: 18) | ATAAATGTGAAAGATGGA | (SEQ ID NO: 967) |
| ESR1 | (SEQ ID NO: 18) | GGGCGTACGAGGATTT | (SEQ ID NO: 968) |
| ESR1 | (SEQ ID NO: 18) | GGGTGTATGAGGATTT | (SEQ ID NO: 969) |
| HSPB1 | (SEQ ID NO: 20) | AGGGTATTCGTCGGTT | (SEQ ID NO: 888) |
| HSPB1 | (SEQ ID NO: 20) | AGGGTATTTGTTGGTT | (SEQ ID NO: 889) |
| HSPB1 | (SEQ ID NO: 20) | GAATTCGAGAGCGCGA | (SEQ ID NO: 892) |
| HSPB1 | (SEQ ID NO: 20) | TGAATTTGAGAGTGTGA | (SEQ ID NO: 893) |
| RASSF1 | (SEQ ID NO: 21) | AGTAAATCGGATTAGGA | (SEQ ID NO: 852) |
| RASSF1 | (SEQ ID NO: 21) | AGTAAATTGGATTAGGAG | (SEQ ID NO: 853) |
| RASSF1 | (SEQ ID NO: 21) | TACGGGTATTTTCGCGT | (SEQ ID NO: 854) |
| RASSF1 | (SEQ ID NO: 21) | ATATGGGTATTTTTGTGT | (SEQ ID NO: 855) |
| RASSF1 | (SEQ ID NO: 21) | TGCGAGAGCGCGTTTA | (SEQ ID NO: 856) |
| RASSF1 | (SEQ ID NO: 21) | TTGTGAGAGTGTGTTTA | (SEQ ID NO: 857) |
| GRIN2D | (SEQ ID NO: 24) | ATTTCGATTTGGAGGCGG | (SEQ ID NO: 716) |
| GRIN2D | (SEQ ID NO: 24) | ATTTTGATTTGGAGGTGG | (SEQ ID NO: 717) |
| PSAT1 | (SEQ ID NO: 25) | TTCGTCGGTGTTACGT | (SEQ ID NO: 718) |
| PSAT1 | (SEQ ID NO: 25) | TTTTGTTGGTGTTATGT | (SEQ ID NO: 719) |
| PSAT1 | (SEQ ID NO: 25) | GGCGAGTTCGGGTAGT | (SEQ ID NO: 720) |
| PSAT1 | (SEQ ID NO: 25) | GGTGAGTTTGGGTAGT | (SEQ ID NO: 721) |
| PSAT1 | (SEQ ID NO: 25) | ATAGTAAACGCGAGGA | (SEQ ID NO: 818) |
| PSAT1 | (SEQ ID NO: 25) | AGTAAATGTGAGGAGG | (SEQ ID NO: 819) |
| PSAT1 | (SEQ ID NO: 25) | AAGTTTTCGCGAGCGG | (SEQ ID NO: 722) |
| PSAT1 | (SEQ ID NO: 25) | AAGTTTTTGTGAGTGG | (SEQ ID NO: 723) |
| PSAT1 | (SEQ ID NO: 25) | AGGAAGTTCGGCGAGG | (SEQ ID NO: 724) |
| PSAT1 | (SEQ ID NO: 25) | AGGAAGTTTGGTGAGG | (SEQ ID NO: 725) |
| CYP2D6 | (SEQ ID NO: 27) | TACGACGATTTTCGTT | (SEQ ID NO: 726) |
| CYP2D6 | (SEQ ID NO: 27) | GAGTATGATGATTTTTGT | (SEQ ID NO: 727) |
| CYP2D6 | (SEQ ID NO: 27) | TTCGTCGATTAAGTCGG | (SEQ ID NO: 728) |
| CYP2D6 | (SEQ ID NO: 27) | TTTGTTGATTAAGTTGGT | (SEQ ID NO: 729) |
| CYP2D6 | (SEQ ID NO: 27) | GTGGCGCGAGTAGAGG | (SEQ ID NO: 730) |
| CYP2D6 | (SEQ ID NO: 27) | GTGGTGTGAGTAGAGG | (SEQ ID NO: 731) |
| CYP2D6 | (SEQ ID NO: 27) | AACGTTTACGTGTTCGT | (SEQ ID NO: 732) |

TABLE 3-continued

Hybridisation oligonucleotides according to Example 1

| Gene | | Oligo: | |
|---|---|---|---|
| CYP2D6 | (SEQ ID NO: 27) | GTAATGTTTATGTGTTTGT | (SEQ ID NO: 733) |
| COX7A2L | (SEQ ID NO: 28) | AATTCGATCGCGGGTA | (SEQ ID NO: 1086) |
| COX7A2L | (SEQ ID NO: 28) | ATTTGATTGTGGGTAGA | (SEQ ID NO: 1087) |
| PLAU | (SEQ ID NO: 30) | TATTTGTCGCGTTGAT | (SEQ ID NO: 1044) |
| PLAU | (SEQ ID NO: 30) | ATTTGTTGTGTTGATGA | (SEQ ID NO: 1045) |
| PLAU | (SEQ ID NO: 30) | TGTAATTCGGGGATTT | (SEQ ID NO: 1046) |
| PLAU | (SEQ ID NO: 30) | TTGTAATTTGGGGATTT | (SEQ ID NO: 1047) |
| PLAU | (SEQ ID NO: 30) | AGGAAGTACGGAGAAT | (SEQ ID NO: 1048) |
| PLAU | (SEQ ID NO: 30) | AGGAAGTATGGAGAATT | (SEQ ID NO: 1049) |
| PLAU | (SEQ ID NO: 30) | TTCGTTGGAGATCGCGT | (SEQ ID NO: 1050) |
| PLAU | (SEQ ID NO: 30) | TTTGTTGGAGATTGTGT | (SEQ ID NO: 1051) |
| PLAU | (SEQ ID NO: 30) | TTGCGGAAGTACGCGG | (SEQ ID NO: 1052) |
| PLAU | (SEQ ID NO: 30) | TTGTGGAAGTATGTGG | (SEQ ID NO: 1053) |
| VTN | (SEQ ID NO: 31) | TTCGGGTTCGCGAAAG | (SEQ ID NO: 1028) |
| VTN | (SEQ ID NO: 31) | TTTGGGTTTGTGAAAG | (SEQ ID NO: 1029) |
| VTN | (SEQ ID NO: 31) | TTTTGTTCGCGTTGAA | (SEQ ID NO: 1030) |
| VTN | (SEQ ID NO: 31) | TTGTTTGTGTTGAAGTA | (SEQ ID NO: 1031) |
| VTN | (SEQ ID NO: 31) | TGGGTCGCGAGGTAGT | (SEQ ID NO: 1032) |
| VTN | (SEQ ID NO: 31) | TGGGTTGTGAGGTAGT | (SEQ ID NO: 1033) |
| VTN | (SEQ ID NO: 31) | TTCGATGGCGGTTTCGA | (SEQ ID NO: 1036) |
| VTN | (SEQ ID NO: 31) | TTTGATGGTGGTTTTGA | (SEQ ID NO: 1037) |
| SULT1A1 | (SEQ ID NO: 32) | TTCGAGTCGTTTTGAT | (SEQ ID NO: 734) |
| SULT1A1 | (SEQ ID NO: 32) | TTTGAGTTGTTTTGATG | (SEQ ID NO: 735) |
| SULT1A1 | (SEQ ID NO: 32) | TTCGTCGTGTACGGTT | (SEQ ID NO: 736) |
| SULT1A1 | (SEQ ID NO: 32) | TTTGTTGTGTATGGTTT | (SEQ ID NO: 737) |
| SULT1A1 | (SEQ ID NO: 32) | AGGATTTCGTTTTCGG | (SEQ ID NO: 738) |
| SULT1A1 | (SEQ ID NO: 32) | AGGATTTTGTTTTTGGG | (SEQ ID NO: 739) |
| SULT1A1 | (SEQ ID NO: 32) | TTTTCGGTTGAAGTCGG | (SEQ ID NO: 740) |
| SULT1A1 | (SEQ ID NO: 32) | TTTTTGGTTGAAGTTGG | (SEQ ID NO: 741) |
| PCAF | (SEQ ID NO: 33) | AGCGTCGGTACGTATA | (SEQ ID NO: 986) |
| PCAF | (SEQ ID NO: 33) | GGTAGTGTTGGTATGT | (SEQ ID NO: 987) |
| PRKCD | (SEQ ID NO: 34) | ATTTCGCGTTCGGATT | (SEQ ID NO: 742) |
| PRKCD | (SEQ ID NO: 34) | GATTTTGTGTTTGGATT | (SEQ ID NO: 743) |
| EGR4 | (SEQ ID NO: 1) | AAGCGTATTTATCGGA | (SEQ ID NO: 744) |
| EGR4 | (SEQ ID NO: 1) | GGAAGTGTATTTATTGGA | (SEQ ID NO: 745) |
| EGR4 | (SEQ ID NO: 1) | TATCGGACGGTCGGTT | (SEQ ID NO: 746) |
| EGR4 | (SEQ ID NO: 1) | ATTTATTGGATGGTTGG | (SEQ ID NO: 747) |
| EGR4 | (SEQ ID NO: 1) | AGGCGTAGCGTTTTAG | (SEQ ID NO: 748) |

TABLE 3-continued

Hybridisation oligonucleotides according to Example 1

| Gene | | Oligo: | |
|---|---|---|---|
| EGR4 | (SEQ ID NO: 1) | TGAGGTGTAGTGTTTT | (SEQ ID NO: 749) |
| EGR4 | (SEQ ID NO: 1) | AACGTTATAGTTCGAGT | (SEQ ID NO: 750) |
| EGR4 | (SEQ ID NO: 1) | AATGTTATAGTTTGAGTTT | (SEQ ID NO: 751) |
| TP73 | (SEQ ID NO: 15) | GTGCGAGTTAGTCGGA | (SEQ ID NO: 752) |
| TP73 | (SEQ ID NO: 15) | GTGTGAGTTAGTTGGA | (SEQ ID NO: 753) |
| TP73 | (SEQ ID NO: 15) | TATCGGTTCGGAGTTA | (SEQ ID NO: 754) |
| TP73 | (SEQ ID NO: 15) | AGGATATTGGTTTGGAG | (SEQ ID NO: 755) |
| TP73 | (SEQ ID NO: 15) | AGAGTCGTTCGGAATT | (SEQ ID NO: 756) |
| TP73 | (SEQ ID NO: 15) | TGAGAGTTGTTTGGAAT | (SEQ ID NO: 757) |
| SYK | (SEQ ID NO: 19) | GAAGTTATCGCGTTGG | (SEQ ID NO: 826) |
| SYK | (SEQ ID NO: 19) | AGAAGTTATTGTGTTGG | (SEQ ID NO: 827) |
| SYK | (SEQ ID NO: 19) | GATCGATGCGGTTTAT | (SEQ ID NO: 828) |
| SYK | (SEQ ID NO: 19) | GGGATTGATGTGGTTTA | (SEQ ID NO: 829) |
| SYK | (SEQ ID NO: 19) | GTTCGGCGGGAGGAGA | (SEQ ID NO: 830) |
| SYK | (SEQ ID NO: 19) | GTTTGGTGGGAGGAGA | (SEQ ID NO: 831) |
| SYK | (SEQ ID NO: 19) | AGTCGATTTTCGTTTAG | (SEQ ID NO: 832) |
| SYK | (SEQ ID NO: 19) | TAGTTGATTTTTGTTTAGT | (SEQ ID NO: 833) |
| SYK | (SEQ ID NO: 19) | GGAAGAGTCGCGGGTT | (SEQ ID NO: 834) |
| SYK | (SEQ ID NO: 19) | GGAAGAGTTGTGGGTT | (SEQ ID NO: 835) |
| HSPB1 | (SEQ ID NO: 20) | AGTCGTGTTACGGTAG | (SEQ ID NO: 890) |
| HSPB1 | (SEQ ID NO: 20) | AGTTGTGTTATGGTAGG | (SEQ ID NO: 891) |
| HSPB1 | (SEQ ID NO: 20) | TTTTTTCGTTAAGGAAAG | (SEQ ID NO: 894) |
| HSPB1 | (SEQ ID NO: 20) | TTTTTTTTGTTAAGGAAAG | (SEQ ID NO: 895) |
| TES | (SEQ ID NO: 22) | TAGAAGTCGGTTCGTG | (SEQ ID NO: 758) |
| TES | (SEQ ID NO: 22) | AGAAGTTGGTTTGTGG | (SEQ ID NO: 759) |
| TES | (SEQ ID NO: 22) | GATTGGGCGGCGGAAG | (SEQ ID NO: 760) |
| TES | (SEQ ID NO: 22) | ATTGGGTGGTGGAAGT | (SEQ ID NO: 761) |
| TES | (SEQ ID NO: 22) | TAGCGGAGTCGGAGGT | (SEQ ID NO: 762) |
| TES | (SEQ ID NO: 22) | TAGTGGAGTTGGAGGT | (SEQ ID NO: 763) |
| TES | (SEQ ID NO: 22) | AATTCGGTCGTGGGAT | (SEQ ID NO: 764) |
| TES | (SEQ ID NO: 22) | AATTTGGTTGTGGGAT | (SEQ ID NO: 765) |
| PITX2 | (SEQ ID NO: 23) | AGTCGGGAGAGCGAAA | (SEQ ID NO: 970) |
| PITX2 | (SEQ ID NO: 23) | AGTTGGGAGAGTGAAA | (SEQ ID NO: 971) |
| PITX2 | (SEQ ID NO: 23) | AAGAGTCGGGAGTCGGA | (SEQ ID NO: 972) |
| PITX2 | (SEQ ID NO: 23) | AAGAGTTGGGAGTTGGA | (SEQ ID NO: 973) |
| PITX2 | (SEQ ID NO: 23) | GGTCGAAGAGTCGGGA | (SEQ ID NO: 974) |
| PITX2 | (SEQ ID NO: 23) | GGTTGAAGAGTTGGGA | (SEQ ID NO: 975) |
| PITX2 | (SEQ ID NO: 23) | ATGTTAGCGGGTCGAA | (SEQ ID NO: 976) |

TABLE 3-continued

Hybridisation oligonucleotides according to Example 1

| Gene | | Oligo: | |
|---|---|---|---|
| PITX2 | (SEQ ID NO: 23) | TAGTGGGTTGAAGAGT | (SEQ ID NO: 977) |
| GRIN2D | (SEQ ID NO: 24) | GAGAGTCGGGATGATT | (SEQ ID NO: 766) |
| GRIN2D | (SEQ ID NO: 24) | GGAGAGTTGGGATGAT | (SEQ ID NO: 767) |
| GRIN2D | (SEQ ID NO: 24) | TAGGGTCGAGATTTGG | (SEQ ID NO: 768) |
| GRIN2D | (SEQ ID NO: 24) | TTAGGGTTGAGATTTGG | (SEQ ID NO: 769) |
| GRIN2D | (SEQ ID NO: 24) | AGTGTGGCGAATATTG | (SEQ ID NO: 770) |
| GRIN2D | (SEQ ID NO: 24) | GTGTGGTGAATATTGAA | (SEQ ID NO: 771) |
| PSAT1 | (SEQ ID NO: 25) | TTTCGATTCGGTTTAGA | (SEQ ID NO: 808) |
| PSAT1 | (SEQ ID NO: 25) | AATTGTTTTGATTTGGTT | (SEQ ID NO: 809) |
| PSAT1 | (SEQ ID NO: 25) | TAATGGGCGTCGATT | (SEQ ID NO: 810) |
| PSAT1 | (SEQ ID NO: 25) | TTAATGGGGTGTTGATT | (SEQ ID NO: 811) |
| PSAT1 | (SEQ ID NO: 25) | TATCGTAGCGGTTAGG | (SEQ ID NO: 812) |
| PSAT1 | (SEQ ID NO: 25) | TATTGTAGTGGTTAGGAA | (SEQ ID NO: 813) |
| PSAT1 | (SEQ ID NO: 25) | AGGAACGTTAGTCGTT | (SEQ ID NO: 814) |
| PSAT1 | (SEQ ID NO: 25) | TAGGAATGTTAGTTGTTT | (SEQ ID NO: 815) |
| PSAT1 | (SEQ ID NO: 25) | GGTCGTCGTATTATGGA | (SEQ ID NO: 816) |
| PSAT1 | (SEQ ID NO: 25) | TGGTTGTTGTATTATGGA | (SEQ ID NO: 817) |
| CGA | (SEQ ID NO: 26) | ATATTTATTTTCGGAAATTT | (SEQ ID NO: 836) |
| CGA | (SEQ ID NO: 26) | TTATTTTTGGAAATTTATAGT | (SEQ ID NO: 837) |
| CGA | (SEQ ID NO: 26) | TGATTTTGTCGTTATTATT | (SEQ ID NO: 838) |
| CGA | (SEQ ID NO: 26) | TTGATTTTGTTGTTATTATT | (SEQ ID NO: 839) |
| CGA | (SEQ ID NO: 26) | TAAATTGACGTTATGGTA | (SEQ ID NO: 840) |
| CGA | (SEQ ID NO: 26) | AAATTGATGTTATGGTAAA | (SEQ ID NO: 841) |
| CGA | (SEQ ID NO: 26) | AATTGACGTTATGGTAAT | (SEQ ID NO: 842) |
| CGA | (SEQ ID NO: 26) | TAAAAATTGATGTTATGGT | (SEQ ID NO: 843) |
| COX7A2L | (SEQ ID NO: 28) | TTGTTCGAAGATCGTT | (SEQ ID NO: 1078) |
| COX7A2L | (SEQ ID NO: 28) | GTTGTTTGAAGATTGTTT | (SEQ ID NO: 1079) |
| COX7A2L | (SEQ ID NO: 28) | TAGCGTAAGGATTCGGT | (SEQ ID NO: 1080) |
| COX7A2L | (SEQ ID NO: 28) | TTAGTGTAAGGATTTGGT | (SEQ ID NO: 1081) |
| COX7A2L | (SEQ ID NO: 28) | AGAGTTCGGTTTTTCGTA | (SEQ ID NO: 1082) |
| COX7A2L | (SEQ ID NO: 28) | AGAGTTTGGTTTTTGTA | (SEQ ID NO: 1083) |
| COX7A2L | (SEQ ID NO: 28) | ATTCGTATTTGCGGGTTA | (SEQ ID NO: 1084) |
| COX7A2L | (SEQ ID NO: 28) | ATTTGTATTTGTGGGTTA | (SEQ ID NO: 1085) |
| ESR2 | (SEQ ID NO: 29) | ATTTCGAGGATTACGTT | (SEQ ID NO: 936) |
| ESR2 | (SEQ ID NO: 29) | ATTTTGAGGATTATGTTTT | (SEQ ID NO: 937) |
| ESR2 | (SEQ ID NO: 29) | AGATGGCGTTTTTCGTA | (SEQ ID NO: 938) |
| ESR2 | (SEQ ID NO: 29) | TAGATGGTGTTTTTTGTA | (SEQ ID NO: 939) |
| ESR2 | (SEQ ID NO: 29) | ATTTTCGAATCGATTTTT | (SEQ ID NO: 940) |

TABLE 3-continued

Hybridisation oligonucleotides according to Example 1

| Gene | | Oligo: | |
|---|---|---|---|
| ESR2 | (SEQ ID NO: 29) | GGAGTATTTTTGAATTGAT | (SEQ ID NO: 941) |
| ESR2 | (SEQ ID NO: 29) | AGTTCGACGGTTTTAG | (SEQ ID NO: 942) |
| ESR2 | (SEQ ID NO: 29) | AGGGAGTTTGATGGTT | (SEQ ID NO: 943) |
| ESR2 | (SEQ ID NO: 29) | AGTTTACGTGATCGAG | (SEQ ID NO: 944) |
| ESR2 | (SEQ ID NO: 29) | AGTTTATGTGATTGAGTT | (SEQ ID NO: 945) |
| VTN | (SEQ ID NO: 31) | GGTGGTATCGATTGAT | (SEQ ID NO: 1034) |
| VTN | (SEQ ID NO: 31) | TGGTGGTATTGATTGAT | (SEQ ID NO: 1035) |
| VTN | (SEQ ID NO: 31) | TAGTGATTCGCGGGGA | (SEQ ID NO: 1038) |
| VTN | (SEQ ID NO: 31) | TAGTGATTTGTGGGGA | (SEQ ID NO: 1039) |
| VTN | (SEQ ID NO: 31) | TTATGTCGGAGGATGA | (SEQ ID NO: 1040) |
| VTN | (SEQ ID NO: 31) | ATTATGTTGGAGGATGA | (SEQ ID NO: 1041) |
| VTN | (SEQ ID NO: 31) | ATACGGTTTATGACGAT | (SEQ ID NO: 1042) |
| VTN | (SEQ ID NO: 31) | ATATGGTTTATGATGATGG | (SEQ ID NO: 1043) |
| PCAF | (SEQ ID NO: 33) | GAGCGGTAGGTGTCGAA | (SEQ ID NO: 978) |
| PCAF | (SEQ ID NO: 33) | GAGTGGTAGGTGTTGAA | (SEQ ID NO: 979) |
| PCAF | (SEQ ID NO: 33) | TAAGATTTCGCGGGTA | (SEQ ID NO: 980) |
| PCAF | (SEQ ID NO: 33) | TGTAAGATTTTGTGGGTA | (SEQ ID NO: 981) |
| PCAF | (SEQ ID NO: 33) | AGTTCGTAGTTTCGAG | (SEQ ID NO: 982) |
| PCAF | (SEQ ID NO: 33) | GTTTGTAGTTTTGAGGA | (SEQ ID NO: 983) |
| PCAF | (SEQ ID NO: 33) | TAGGGCGCGGAGTAGA | (SEQ ID NO: 984) |
| PCAF | (SEQ ID NO: 33) | TAGGGTGTGGAGTAGA | (SEQ ID NO: 985) |
| PRKCD | (SEQ ID NO: 34) | ATTTATTTTCGTTGTAGG | (SEQ ID NO: 772) |
| PRKCD | (SEQ ID NO: 34) | TATTTATTTTTGTTGTAGG | (SEQ ID NO: 773) |
| PRKCD | (SEQ ID NO: 34) | TTTCGGAAACGGGAAT | (SEQ ID NO: 774) |
| PRKCD | (SEQ ID NO: 34) | TAGTTTTGGAAATGGGA | (SEQ ID NO: 775) |
| PRKCD | (SEQ ID NO: 34) | GGACGGAGTTATCGGT | (SEQ ID NO: 776) |
| PRKCD | (SEQ ID NO: 34) | GGATGGAGTTATTGGTA | (SEQ ID NO: 777) |
| PRKCD | (SEQ ID NO: 34) | GTTTAGCGGAGGGATA | (SEQ ID NO: 778) |
| PRKCD | (SEQ ID NO: 34) | TGTTTAGTGGAGGGAT | (SEQ ID NO: 779) |
| ESR1 (exon8) | (SEQ ID NO: 61) | TTGTTACGGTTTGAGAG | (SEQ ID NO: 780) |
| ESR1 (exon8) | (SEQ ID NO: 61) | TTGTTATGGTTTGAGAGT | (SEQ ID NO: 781) |
| ESR1 (exon8) | (SEQ ID NO: 61) | TTTGTTATAGTTTGAGAGT | (SEQ ID NO: 782) |
| ESR1 (exon8) | (SEQ ID NO: 61) | TTTGTTACGGTTTGAG | (SEQ ID NO: 783) |
| ESR1 (exon8) | (SEQ ID NO: 61) | TTTGTTATGGTTTGAGA | (SEQ ID NO: 784) |
| ESR1 (exon8) | (SEQ ID NO: 61) | TTTGTTATAGTTTGAGAG | (SEQ ID NO: 785) |

TABLE 4

Numbers of censored and relapsed patients in randomly selected sample set of ER+, N0, untreated population.

| | Frequency | Percentage |
|---|---|---|
| Censored | 276 | 66.5 |
| Distant metastasis | 66 | 15.9 |
| Locoregional relapse | 49 | 11.8 |
| Contralateral breast | 24 | 5.8 |
| Sum | 415 | 100.0 |

TABLE 5

Numbers of censored and relapsed patients in ER+, N0, TAM treated population.

| | Frequency | Percentage |
|---|---|---|
| Censored | 485 | 89.6 |
| Distant metastasis | 31 | 5.7 |
| Locoregional relapse | 20 | 3.7 |
| Contralateral breast | 5 | 0.9 |
| Sum | 541 | 100.0 |

TABLE 6

Primers and Amplificates according to Example 3

| Forward primer SEQ ID NO: | Reverse primer SEQ ID NO: | Amplificate SEQ ID NO: | Amplificate number |
|---|---|---|---|
| 1150 | 1151 | 1152 | 1 |
| 1153 | 1154 | 1155 | 2 |
| 1156 | 1157 | 1158 | 3 |
| 1159 | 1160 | 1161 | 4 |
| 1162 | 1163 | 1164 | 5 |
| 1165 | 1166 | 1167 | 6 |
| 1168 | 1169 | 1170 | 7 |
| 1171 | 1172 | 1173 | 8 |
| 1174 | 1175 | 1176 | 9 |
| 1177 | 1178 | 1179 | 10 |
| 1180 | 1181 | 1182 | 11 |

SEQUENCE LISTING (1182 sequences)

SEQ ID NO: 1 - DNA, 4200 bp, Homo Sapiens
gaaaatgagggttggctttgaagttggacagatttgtttgacctgtctgttcctagcctgggttaactacattgttccagcaagctatctacattgcttccacatctttgaaatgaggtatatgcctgctttatttgggaatgcgaggattaaggagaataatatatacataatgttgaacacctacgccttttaaccactttgaagttccagaaacacctccagcccttaggtgagctgtgattaaattcgttcattaacccaacacacatttactgaatgcctactctgtgccgcagttcctggcaggtgtgcctgacagtgggtgtgtaatatgttcagggtctgtatcccatgagcgtggggatctcctttatcttctggcacatatggtcctgggggagaagctaaggggaagggtcaggagcttacatggcagattcagtaagcttttagcacaataattttaattgcaaaaataaacagttttgtcaactgcttgagagtagcgtctgctttacaaaaattaacaacaacaaaaggaaaaaaaacccaaagcaaaacgttacatccaatggctgctggataagacactgctgtacaaagtcccgcgcgagaccgccttggcgctgccccagcctgtctctgggggttatagaggaaggcgtggggcgtgtgccagttacaaaagactgtcttgaatcccagggtagtgcctattcactgggtggtctcagaagacttcccccaaagcgcggctgacaagggtgacagcgcctggaccgcgggaactgtccgcggagctggtgctgaatagggcgtgtgcggcgggcgcttcaaggaaactggaagcgggaccggaggccggccctcgggcgtgcgaggaggagttggaagaagagcggggaggggaacggcccggaactcgtgcgcgccgaacggcggcgccccaacccataaacccatctcttgctcagagagaagcgaaggagaggcccagcgagtaaaagccgaggcccttgagccgctcctcggcgcgcgccttctgcttgaggtgcaccttgctgtgccgtttcttctcatcgctgcgcgcgaagcggcggccgcacacgtcgcaagcaaaaggcttctcgccggtgtgggtgcgcacgtgcgtggtgaggtggtcgctgcggctgaagttgcggaggcagatgcggcactggaagggtttgtggcccgtgtggatgcgcaggtggcgattgagctcgtcggagcgcgcaaagctccgcacacaactctccaccgggcaagcgaaggccttggcgtgcggccgcgggcagaagcagcgcgtgctgcatttgccgccgcggcgccccttgcgtcgcgccttggcctgggggaaaggggtgggcggcggcggcggcacgggtggtgcagccacgccactgcttccagggatgtccgccaccagaggtttagggaagtccgccgcggcggcgctgcgaaggcccagcggggaaagctgaggctgcgtactggccagaaactctccgccgtcgccgctactccctccctccccactaggaggggtcaggagcccagggaggccctcagccccctcccctaagtcacccggggccagcgggaaagcgtcataggccccgctgggatagagtctgttggctgggacggccggcagttccgcagggcagctgatggacagcaagtcctcaatcttggtccctattacgggaaaacgagcctccggggcggcctggtagtctccctgtgacccacagttccctggggcccccacagaaagcagctcccagggcgcgtagggacccttgaaggcagagacagcgtccagcgctggcgaggcgggaggcgcccggaggccgggcttgacgtcgggcggggagagctgaggctcatacaggcactgcgagggggcacccgcgcaaggcgaggcctcccagaacgcctctgggaaaggggcagcgcccagatccggggagtaaaggtccggcggacccggcagcaaggcatcggaccccgcaggaaaaggggcatccagcggggatctggacgctgctgcctctggaccggggaagggtgccaggcctaagatgcccgacatgaggttgaagagtgcctccgggtcgtgcgggtgttcgggcactgcctgaatgaagaagctaccgctgtagctgaggccgggagggggtgtgggcgcaggcccctccaggaagcaggagtcggctaagtccccacttgcgccgcagctgttcaaagcccagctcaagaagtcgcctgctgaggagggagcaggaatcagctctgggcacatcaaagggtgcacctgagtccacagcccctacctacaaaactcttggtgcccacggatatacacaaagtgccttttgcacattctgattcagcaggggcccgcatacgtcccaaggagcacatagaaacatgcacacgcaaaacacacgtgcacaggcaaaagggcgctccgataaccgcacaggttcctgcggaggcgctggcggcccagtgtgggtgggaatgggggtgcgcaccccaggactcctaagcttcccatcgcccctattctcatagctccaatgtcccagtccctcctggttctcaggtatggtgcgcccccgcgctgcgccgtcgtcgtctgagcacccctgctcgccctccttacctccagggtagccggtggccgcgggagcgtccctggcaggcagccggggcaattcagcgctgggttcggcgcaacagccttcagtggacttgacgaggagcgcgtcgggttcggaaaactcgctaaggtggagcatggcgcggcgccggctgtggggcgcccggggcctcgcccgctgggcttgggggcgcgcgggtggcggggaggctggcggtaggggttccccgcagcgcacagacctaggcgcccgggctcctggcttcgggcactcacctctgggaaaggagtcggggagccgcggcgccctcgctcgcccgcaccggcctcgggcggcggctcctcgcctctccaaagcgctgccgggctcccccagcccacagcccccccacttatatagctgcggcggcgctggctccgggcttccgactccccgggccactgccattttgggaggccccggccctgccgccgtgacgtaaatgcccaaacatggacacaggatgtgtgccggggactcccgaaaaggaaagctcgagctgtgacgttgttgttgtcgccgccgccgccaggctcgcgccgctgcgtgcgcgcgcgctccccaggcgtggagcgctggggccgcggatgcgccagtctggggcgctgcgcctcaccgggccgaccgtccggtagatgcgcttcccacctggaggcagaggccgaggggcagcaggggaggaccgtgttgggtttgaatctgccctctgccactaactagcttgacactcagtcccccttaacgtcagtttctcacctgtgcatttcctgtggagagaaactgagagcacataaatgtccaggcgcactcagtaaaccacagagattattgccattcatttcttttgctcacgcctgtgtgtttttccattttaagttttttttttttaaatttgtgctaggaaaaataatttaaattaaaaaggactgtaatacttgttaacagtaggaggaaagtcaactagcacaacagggtatattctaaattgaaaagtaaaagtccctcctctccacctaccttcattcctagctcctgaggtagccacatttaagtttcttgggtattctttcagaagaattttatgtatatccaaccatacacattgttctgcaatattattattattattattttttcacttgaaataacttagagattgtgccatgtcctgacataaagatcttgtcattctttttcaaggctgtatagtactccattgtaagggaggaccttgagttagtcgatttgtcccctatccatgagcatgtaggcagtttccaactttttacttataccaatgttgttggagtcaacatccttgactatataaatgtgaatgtgtctgtgagataaattccaacgagtgtaattgtgtgccaaagtatatgtaaaattttgatagacaactggcaaattgtcttccagaaaagtagggccaattcctgctcactcctccctcacccac

SEQ ID NO: 2 - DNA, 4491 bp, Homo Sapiens
ttcagtaattttccatgctgaaatttggcccagtatactttgattatatatctatatttaattatagttttaaaatagctaagcagttttaaaaattcaaattaaacttttgtggaatctctaaaaataagaaaaatattactgagtaattggcaacataaaatacaaaatgtttaacttggctttcttttagatttgaagcatagtgactaatgaacatataatggtcgtagctttctttacaactatgtcatttaagtcactgatgaatatctatgatacatgcagtaaaaatttagacaaacattttggctacaaactggtttactaaataatagcttgtatcatagtctgagtcaagagtaataggcttacaattgtgtcttagggtactaagaagttcttttgaggaccttttaaaaggtattctttgttttgaaagactgttttccttctggaagttctaggccttatgagaaattacctattctgaatttgtcacaaaaaatgacttgtaaataagtcctgtgcagtgaatcatgtgctttcagtaagaggattttgaaagccttttgtaaaatgaagtcattctcaaaagagagttatttagaatataatcaaattgatttacatgcttttatttatttcaaatatgaagggaaattgtttctaaatatatttaaacttttaatagaacagtagtatgccatcagtgtggaaataactcacttgttaaataaatatttggggtgtatttgctgtatatcaggcattgtaacacagggactaatgaaagagaaaaaaaacaaagcacgaaaggacagcagaaatagctccataatctcactttccaggaataacctctatggacattttgttgtgtgtctattgcttttctaatatatacattttttaatcaaatggaattgcctcaaatatgctatttaatagcttgcttcttttcatactatttgaaaattaagaaacgattataatatgcttcatttaaaaactttaagtttaggccgggcacagtggctcacgcatgtaatcccagtacttggagggaccgaggtgggcggatcacaaggtcaggagattgagaccatcctggccagcatggtgaaaccccgtctctactaaaaatacaaaacttagctgggcatgatggcacgtgcctgtagtcccagctacttgggaggctgaggcaggagaatcgcttgaacccgggaggtggaggttgcagtgagcggagattgcaccactgcactcgcctggtgacagagcaagactctatctcaaaaaacaaacaaagaaaacttgaagtatagtatccttttaaattttaaatagataatagaaactggtttccccccatttaaaccagaatttaagtttaactttatatattcttgacagtttggattttgtccttcaacctcataaaattgggaatttaagcatcacctggttcgatttaaatgcaatgtagaatttgcattaaaatactacattaaagcctcagatttgtagtagctaacagcacttctatgtatgtgtcagggactgctctaaatacttcatatatattaactcctctattctgtacttctgttcccgttttatacagcaggaaattgaaacactgagaggttaagtaactaaagttacagagctagagtgacaggagtaaagcttcaactcaggcaacccagacttccagagttctgatctccactactaagctgctagcatagcttttctggtaactatttttaattcaaatataattcgagtgatctatctaacaagtcatcactctgacaactcagtgacttgtaatgtaaaattattcattgtaattcatttaatattattgtttctctgtgctgcaaaaatcatagcaatcgagatgtaatttattactctccctcccacctccggcatcttgtgctaatccttctgccctgcggacctcccccgactctttactatgcgtgtcaactgccatcaacttccttgcttgctggggactggggccgcgagggcatacccccgaggggtacggggctagggctaggcaggctgtgcggttgggcggggccctgtgccccactgcggagtgcgggtcgggaagcggagagagaagcagctgtgtaatccgctggatgcggaccagggcgctccccattcccgtcgggagcccgccgattggctgggtgtgggcgcacgtgaccgacatgtggctgtattggtgcagcccgccagggtgtcactggagacagaatggaggtgctgccggactcggaaatggggtaggtgctggagccaccatggccaggcttgctgcggggggaggggggaaggtggttttccctcgcactgtcttaaaccgatggcctttccttggcacagggtccactgcagcatgccaaacgaggaggcaggggcgtcgtccccccgccccccactgcagcactggagatggatttcctgtacttcggatccagggtttttgacagaagaggaagaagggggaggggtagaagtgttaaggggagtctgctgagaaaagctgtttttgaagccagaaggggtttttgtttttataatgccatttgacagagtggaataacagtatctaaggaaacgggtagaggacaacaaagaatggagcatattcatggcgaggagcaaaagctctaccccattgaaaggcttcttttcctccctggcgacaaggacacatgcattggtggccaaaagagagaggagacaaaaccgctgcagatggctgatgtgaatctagtggaaagagctactggggatgagagaaagaggaggaggcaggtactgcagagcgtgagtggtggtgttggttggtgaaatactggtcaccagtagtgtgcctgcttttgtaaaacatctaagtaaactccctgtgaacagggtggcaaacagataccagtgtctttgttagttacaaaatgcagtggtagtggctttttgcggacgactgcagcagtgctttttctccctctgttaggccgaaaagacaactgcagaggaataagaaaccttgcagcaaatgctggggtagaagcccatttacaagaagccatagtttataaatgcagcctgaacagcagaaaaaaaattactgttttttaaagtaggaataatgtcaggctatgaatgttttgtcattggaatgtattggacactttgattctacatcacgaaagtgatgctcaaattctttgatttaacataaatcctatacgaaatcttaataaattatgtatgaaacagtggatcttttcttttgttagtgaagcttttatgccattaattaggtcattcaagagcaaaccactttacaacgtaaattactttgtcaaaaattatggtgaacaaatttttgtaggcctaatatttaagacctatagttaagtaattttatatttctctttggttgcttttagataacactgaataaatatttaagatattaattcagtgtgcaaatattttaaattaaagcaacatggcttttcttctagatgtatttctgtttagtgagtactcatgagatatactcttgatataaagtgtttttcattgagcttttttttcctttacctaaatgtaaaagcctatctttatgcatacttatagtagccagcctgccacacctccccactccctgaacaaggatggcagtggctttgtaaagccctccagggtcagtgacagtgtctcttaaataatgtttatgtaatagaaagtcttaagatgacctattatattgtttcagtaatattttcaagataatgcggaattgggctggcttagataaataagactacataagtttttcactgataaatttaaatagttctttaaaaaattatttctgctttaagaattacttgatcatggatatcagggttaatagtacttaggagccgggcgtggtggcccatgcctgtaatacaagctaaacaggaggctgagggaagctgaggcaggaggatcacttgagccttggcgttcaagaccagcctgggcaaccaagcaagaccctatctcaaaaaaaagtacttagagtctcttttttaaaatctgatggaaactatggctagaactaaagatgtcacattaaaattccaaatgacatttaacagctaatattactcagttctttgaattccattagcatagtgtttgagagtctataaaactattatttttacataaattaccttttaccattttaacagctcattgtagcattatttttattttaaatgttagagactcctattcaagtatgttgtgactttatccaaggtcaaatattgtataacaatgtaaagaacttaagtcttctattttattctaattctataaaactataatgccttttattacatacatacaaaataatatataacagaggtaatttgaaaaacagtgtaagtcactgac

SEQ ID NO: 3 - DNA, 4256 bp, Homo Sapiens
acacttcccaggtttatgatttgagagttcattaaacaagagatggtcacctctttggttcctaaatcatcttggaaacaaagccatttccagagaggaattttaaaatactgtctgcagtcatagcaaccttaaaatttgagtgctgcatggtggaagtagacaatttattttaggataactgttatttgttatattagtttgaggatggtggtgttaaagaggagttacttatttttaggtacatttcatactaaacacaaattgcataatttgcctaaatcaaggaattatactaaattatattatggttattaaatcctgtcctgagaaagtgaaactgactcagttttcaaagagacaaagagaaagtataagcaaaccaaattgcagctacaaaaagaaagacaaaatgttgcagtatatttattgttttgtgtattcaatgaagtccttcgtcttggtcataaaactagccttaaaggtttttcttatatttcatagtatgaaaaatctaaaaagtaacccatatgtaaatatttaaatcatgatagaaatccaaagcaaaaagaaaatgaatcaattgaattaaaatgtgtaggatgcttaaacccatttgataatatatccatttgataatatactaatatgaatttagtactttaaaatgttatataaataaatgttcctatattaaacaccaatgtagttaggattctaagccaacatcatttccccttttctacatgttcttctcccgtctccattaaaaattgtcaaaactatccacttttctttttcctttttgtttttaaacaaataaggtctcttctaagatattgtaggactacaaagccaaactcccgggttcaagctgttggcaaaattttagagatgctaagttacccatgtattaattacttttaaatcctcccctaactccctcacaaaacaggagtagggagaggagaaacacctctgttcaaaaatgaggaattgaaaactcttatcacaaataaactatatcaagtaagctaaagatagtaaaagagcaaaaatgttagcagatattcccaaaatggtaactacatattacctctggaatgatcacatgaatgtggctcattatttcctaagttcctacagcaaacatatatttatttgccctactcagttaaaaataaacacaatatgtagttgcttctgaataatttttctctctctctttctctctttctttctttcgacaaagtctcactctgtcacccaggctggagtgaagtggctccatctcgctgttcactacaacctcagcctcccgggttcaagcgattctcctgcctcaacctcccgagtagctgggattacaggcgcctgccaccacccccggctactttttgtatttttagtagaggcgaggtttcacctgttggccaggctggtctcgaactcccgacctcaggtgattccccccgccttgatctcccaaagtgaagggattacaaggcgtgaggcaccgcgcccggccgcttctgaataatttcgatcaaaatttatattcgatatttattccaacatacaccacagatttccactgataatccctcctagtaagaaagataagctccatccaggtatctgtgaattggaggctaagtagtcccagcacatcttacatttctttaagactccctttttatcccaaacgttcgtaaattttgtatctgataaagagcatacttccatctaatacaaatatgttccccccttcagatcttctcagcattcgagagatctgtacgcgcgtggctcctcattcctcttccttggcttcccaagcccccagggcgtcgccaggaggaggtctgtgattacaaaccccttctgaaaactccccaggaagcctcccctttttccggagaatcgaagcgctacctgattccaattcccctgcaaacttcgtcctccagagtcgcccgccatcccctgctcccgctgcagaccctctacccacctggatcggcctccgaccgtaactattcggtgcgttgggcagcgcccccgcctccagcagcgcccgcacctcctctacccgaccccgggccgcggccgtggccagccagtcagccgaaggctccatgctgctccccgccgccggctccatgctgctccccgccgcccgctgcctgctctccccctctccgcagccgccgagcgcacgcggtccgccccaccctctggtgaccagccagcccctcctctttcttcctccggtgctggcggaagagccccctccgaccctgtccctcaaatcctctggagggaccgcggtatctttccaggcaaggggacgccgtgagcgagtgctcggaggaggtgctattaactccgagcacttagcgaatgtggcacccctgaagtcgccccaggttgggtctcccccgggggcaccagccggaagcagccctcgccagagccagcgttggcaaggaaggaggactgggctcctccccacctgccccccacaccgccctccggcctccctgctcccagccgcgctcccccgcctgccagcaaaggcgtgtttgagtgcgttcactctgttaaaaagaaatccgcccccgccccgtttccttcctccgcgatacaaccttcctaactgccaaattgaatcggggtgtttggtgtcatagggaaagtatggcttcttcttttaatcataagaaaaagcaaaactattctttcctagttgtgagagccccaccgagaatcgaaatcacctgtacgactagaaagtgtccccctaccccctcaacccttgattttcaggagcgcggggttcactaagtcagaaaccctagttcaaaggattccttttggagagtcggactgctctctccttcccctccccttcccctcctgcgtgtaaaacggctgtctggggcaagggtttctcagacgtgtacattgcctggtataagagcagactctgaaaagatgaggtttatttaatacggacgggggagaattctgcctgtaggcagataggaaaatggggagggagtcattggaaggacggactccattctcaaagtcataattcctagaccagaaaaagtgctcagtgttctagaagcagagttgcacagtgatccaaagaccagcttcaaatactgtcctgtctccttcacacttctcacatttctctttcctactgaaaataccttgcatttttcgtaattataaagggggaagggaatatgagtgccccctgctttataggggttgttgtgagtttaaatgatgtattaatacatataagccttaagaacagtgccacacatcctaagctaatacctgttagctcttgaattatccgctttgaggactggcttgcaatcttgttttgaggcatagaaagaaaatgctttggagcaggacgcggtggctcacacctgtaatcccagcactttgggaagccgaggcgggcagatcacctgaggtcaggagttcgaggccagcttggccaaaatggtgacaccccgtctctactaaaaatacaaaaattagctggccatggtggcgcacgtgtgtaattccagctactcaggaggctgaggcaggagaatcgcttgaacccgggaggcagaggttgcagtaagccgagatcgcgccaccaccctccagcctgggtgacagaatgagactccgactcaaaaaaaaaaaaaaaaatgctttggatagaattatcactattacataaaaggaaagtccggatgcggtggctcacgtctataatcccagcattctgggaggccgagacaggcggatcacctgaggccaggagttcgagacaagcctgaccaacatggcgaaaccctgtctctactaaaaaatacaaaattagcggggcttggtggcgcatgcctgtaatcccagctactcggaggctgatgtaggagaatcgcttgaacccaggagaaggcggaggttgcagtgagccgagatcgcgccattgcactccagcctgggagacaagagcgaaacttggtctcaagaaaaaaagaaagaaagaaagaaagaaagaccaagaagaacttactccctgaaaagattatgggcaccctccaccaccctcacttacaaagaaaagttaaacagcactaaagagtataacaagcgcaaggaggtaaaagttctaatttttcctgtgactactactttttaagcttatcaaaaacatgtactacgtttta

SEQ ID NO: 4 - DNA, 4414 bp, Homo Sapiens
aatgtctggagtatatatttcaatgaacattcattttattttatttctctccattcctgaatcaagcaatcttgaatctaaagttgctatgattagcactgaaaagaccactggactattaattgtgtgactttgggacagtaactttctgcaccttagtttgtttacatgttatacatgaaggttgaagtctgattctgctctgtgactatcattctaaacatctgatgaaatcaaatttcagtgtttggaatggtagtacaataaatttactaagaataaataattcactgcaaaaacacattgatttccaaatgatgtaactgacagttatattactgcagagggctgataaataacaaaagaaatgaaagatgcacatggtgagaactgaaattatcctgacaagtcttctacctgtttatcacttaaaatcaatgaccatgctgaatgcctacaaattacaaaatataaaagaaatcttataaatgcgcatgtacaggagtctaagttactaaaagttttaaagcataagtttaaaccaaactaatcaaagaagttgagaggaaaaattggctttcatctttaatcactactgttttgaggtcctatgtttaatataattttctaagtagaggcttcagagagaagagttgtgaggatactttcatatttgtgtagaaggaaaagtttgccatccattctagtatccctagtgttatactgatgtgcaccttggatttattttgttcctattgtataaactcatacttgacttcaaagaaaaggaaaatccaaagtccctcttttctaaggggacagaaatcctttgtgtcaactgtttgacccttttctctgtaaggtcctattggaaatcttttgtaacacaatgcaggggactcttccatgtgttgatgctgtttacacagtggggtgggcctgactgaagaaaaaaaatcgcatatacgcatgaaagattatggtcttatttccggaaagcatgaaaggtgattgatacttccaagaagtccctgttactcaggaaaattatcaaatattctactcagagatacttggaaagactgaaggaaaggaagaacgaagaaagcagaatctagacttatgtggggagagatttgtggcagaggaaaagtattctctttgaatccgacaagggatttgcctgggggaatttcctgtccagccttttattaccagggtcttttgaagccgggctccccattgggcagttccctgggagtgcagtggggaattcttacactttccctctaggtccccgaaggatctcgttttctcagtgtctctttcaggttggcaggagccttgagcctgacacttccctttgatgggacaggcaagctctgtgggcgcgtaaacacgctgtaaccaagttctttgctgattttacagttttgtgtgctcccgagaagaagtgatcgtactcaattgtctattgctggcctgccccctaagagcctgggggctcctttcccctaacccagaactagctgcacggggggcggggaaatgggggtggggaaggagtgggagggcagtggtttccgcgagcagagcgatgttactgagtgagtccctgaatggggagcgctgctgtccccaagccgattggtacttcttgtcaggaagaaacgccaagaggtgggagtgcctggggagggaggcaggcggtccctaccgcaggcgcggggagctgcctttccgcccctccgcctgctttccaagcctggactcttaggagtggctgaagctgcggagcgcttttggagcctgtgaatgaaccctcctcctctccctcctccttcttctcgctgagtctcctcctcggctctgacggtacagtgatataatgatgatgggtgtcacaacccgcatttgaacttgcaggcgagctgccccgagcctttctggggaagaactccaggcgtgcggacgcaacagccgagaacattaggtgttgtggacaggagctgggaccaagatcttcggccagccccgcatcctcccgcatcttccagcaccgtcccgcaccctccgcatccttccccgggccaccacgcttcctatgtgacccgcctgggcaacgccgaacccagtcgcgcagcgctgcagtgaattttccccccaaactgcaataagccgccttccaaggtaatcacgtttcttttgttccccccttaaaaaacaaaaacaaaaaacttatagaaaaaaacccgcgagcttagaaaaaagaagcaattggtagaaggctttaattaaggcaaagagctgtaaggcgaagttaagaaaatgtaggcacttaaaaaatgcaggtaactttcataagggcttttggggagaggcatacagagggaccttggtgttgaaaaagattcagacaaaagaaacccagggtggggtggggggtaaaatgactaacggaattgggggaagggagggaataaattgtaaagaaatcatagaaaagtggtgggttcttgagctggagagaagagagggacctttggcactttgatttttttgttgttgttgttcttaacacgctcgaggcaaaagtttgaatggggactaccaagacttgccacagacaagtccccgaagccgccttggtgcaggccacctggtttcccagcccctggtgtgtggtcagtgcctggtgttcctggaaagccactcccgggcagctcctgacagtgcgacccggcgcccaagcagcctgggaccttgcgcggacctgaccccttcagaccgcaggcagtctgggaggaggtccggccgggggaggtgcaggatccccgccgtgtctctttgacgacttggggactgtcacggttctctcccggcgcccctgggttcttttgtcctgcacgcggtgcgaaggggccagcagggaaggagcagaggatggggggtggggttgttggagccccgcggaggtctgggaggcccctgggcgggaaaagcctgttctgaatcggcagggatgtgcaacaatttttctcaccctgaagagtgaaatagggtctgtcgctcccatctcaacaagcaaaccggcacccagagcgcactgcagacaaaggtggctcggggacccgaatcaggggcctctgggtcagtcctctcgcccagactacaggagtcctccgtttccttacatattccccaccctctcctagttctccgctctagttgagcaactttactggcaggtctagcggcagcggcgcgcgcgtgtgccgggagccccgggggacgtcctcggctggagcgccccaccgtcctgcagaggcgtgggcgctgtagggcgacatccctggtgcgtgcagacctagggcatccgggttgttctggcccgcggtctgtgtcactgggcgtggagcggtctgggtgttaggcagaggagagcggggtagaaaaatagtgtcatagcctaaactatttgctctccaatccaactgcgtctcggcaagtcctgcatgtccctgggagatgctgcgggaagggggagaaatctacacggcgcctggagagttgtcctgccgcgcgcacacccgcggcagagtctctctgggtcgcgttcctcatctttgtgtctccctctgtctccatcttctctgcctcccttcccctctcccagcctctgttctctctctctagcttctgcgtcccctcccccacagctgacaaatgaatggctagtgtgaaatccctgcctttcccgtgctccaaggcagcagggagggaggagcgagggaggcggtgcgctccttcggatctgcccccagttcagctcacaagacttgcagaacctagatgtctaggaattgggagttttgcggcgggtgtgggcgccccctgatggagaagtcccgcacaggcggagaaaaacaagccccccagaccaagcgagcatctttcacaaccttgtgttcaaggatggaaggccctagttttcccttaagtcattcattttgcactccacaatctgcggcgtacatctaggagtttggaggaccctgaaaaaaggtcttggtctgtgcaaagtgcagagatgccttctcgcgagtcggctggaacgcacgcggcgccctgggtccagttcgccgcttagtggacgaacgcacatggccagggtggagccaggtttcggaggtctagacgcgccaccctgggcgtctttaagaaagataatacacataccgtgctctcaaaacccatgaccacttgaacccaacgctagggccccgccccaggatattgcaaaagaagggctcctaatccaaaacttaaacttcctcaacttcagggcgggcgtcggacgggaaagtggagagaaggcgggcagtgggaggaaaaaagaaagggaaggaaggga

SEQ ID NO: 5 - DNA, 4001 bp, Homo Sapiens
ctgatatggaatagagtcaagatttttttttttttttttgacacggagtctcactctgtctcccaggctggagtgcagaggcgcaatctcagctcactgcaagctctgcctcccaggttcacgccattctcctgcctcagcctcctgagtagctgggactacaggcacccgccaccacacctggctaattttttgtatttttagcagagacagggtttcaccgtgttagccaggatggtctcgatctcctgacctcgtgatctgcctgcctcggcctcccaaagtgctggaattacaggtgtgagccaccgcgactggccagattcaagatttgaacccaggtcctcttggtcccagaggcccctgtttctcaactccctaggatggcatagcaacctgtcccacaagaggtgcctgctttaagtgtgctcagcacatggaagcaagtttagaaatgcaagtgtatacctgtaaagaggtgtgggagatgggggggagggaagagagaaagagatgctggtgtccttcattctccagtccctgataggtgcctttgatcccttcttgaccagtatagctgcattcttggctggggcattccaactagaactgccaaatttagcacataaaaataaggaggcccagttaaatttgaatttcagataaacaatgaataatttgttagtataaatatgtcccatgcaatatcttgttgaaattaaaaaaaaaaaaaaaagtcttccttccatccccacccctaccactaggcctaaggaatagggtcaggggctccaaatagaatgtggttgagaagtggaattaagcaggctaatagaaggcaaggggcaaagaagaaaccttgaatgcattgggtgctgggtgcctccttaaataagcaagaagggtgcattttgaagaattgagatagaagtctttttgggctgggtgcagttgctcgtggttgtaattccagcactttgggaggctgaggcgggaggatcacctgaggttgggagttcaagaccagcctcaccaacgtggagaaaccctgtctttactaaaaatacaaaaaattagctggtcatggtggcacatgcctgtaatcccagctgctcgggaggctgaggcaggagaatcacttgaaccagggaggcagaggttgtggtgagcagagatcgcgccattgctctccagcctgggcaacaagagcaaaagttcgtttaaaaaaaaaaaaaagtcctttcgatgtgactgtctcctcccaaatttgtagaccctcttaagatcatgcttttcagatacttcaaagattccagaagatatgccccgggggtcctggaagccacaaggtaaacacaacacatccccctccttgactatcaattttactagaggatgtggtgggaaaaccattatttgatattaaaacaaataggcttgggatggagtaggatgcaagctccccaggaaagtttaagataaaacctgagacttaaaagggtgttaagagtggcagcctagggaatttatcccggactccgggggagggggcagagtcaccagcctctgcatttagggattctccgaggaaaagtgtgagaacggctgcaggcaacccaggcgtcccggcgctaggagggacgcacccaggcctgcgcgaagagagggagaaagtgaagctgggagttgccactcccagacttgttggaatgcagttggagggggcgagctgggagcgcgcttgctcccaatcacaggagaaggaggaggtggaggaggagggctgcttgaggaagtataagaatgaagttgtgaagctgagattcccctccattgggaccggagaaaccaggggagccccccgggcagccgcgcgccccttcccacggggccctttactgcgccgcgcgcccggcccccacccctcgcagcaccccgcgccccgcgccctcccagccgggtccagccggagccatggggccggagccgcagtgagcaccatggagctggcggccttgtgccgctgggggctcctcctcgccctcttgccccccggagccgcgagcacccaaggtgggtctggtgtggggaggggacggagcagcggcgggaccctgccctgtggatgccccgccgaggtcccgcggccggcggggccagaggggcccggacgagctctcctatcccgaagttgtggacagtcgagacgctcagggcagccgggccctggggccctcgggcgggagggggcagttacacggcagcggctcgagatggcccatccaagagactggcgctttccaggctccgaggggctccgggaacttgtcaaagaagttctctgaaattgttcagaaagttttcccgcaaagggtgtattgcgtagagcgcgcgcgcgcgtttccccccttcttgagccccctcaagctttctcaaagcctttccagttggcagcctccgcctccggactggcctgggctggattccttgggggggtcctctgccctgcccctcctccagcccctccccgctccccttcagacgattttggtttggttgctcctgcttctggcggggtcgggtgtgtgtgtgtgtggtggagtggagggtggcatagcaacctgtcccaaccagagccggggaggaaagggtggcccggagggtggcctcttgctggggtctgggttgggggcgggggagacgtttgctttgaacagattcttggggccagcttagggactgtgctctgtgacttttggagcgcgtggaccatggaggggtgggggtgggtttcttggggtgtaaagtgggagagttcccagagaaggaagctaagaaataaggccagatgggagcctagggagggctgcgttgttctgctgccttttccttggtgctgtgcgtggggaagggtgagtgggggcagtgtgtatcctgacccatctgtccacctgtgtgcattaatcataaaagctaacatatagcctgggccaggtatactctgccaggaactgtttgtggtgttttgcatgcattctcctttaatcctagaacacccctatagtggaagttctgccagcattctggactgagtagcagtccagaggttgagtagcagctagtaagtggtggggtcaagatgggaccccaggcagtgcgacccccaaccatgcattcgaaatcgctatatggatgagtgcacctggagcaatgagggacactgctccctgagtcactgggctgcaggggagacaaaatgaaagtgttctgggagtcgtgggtggtctccataggtcagagggtctggggagggagtgggtgtcatcgtggctgtgtgttgcccgaggggccctctgtgagtgagtgcatggccgtgttatctctgcaggtctacgccagggtgttcctcagttgtgtggtctttgtatttgtgtgtctgggctttgtgttgccaaacagcagtctctctgctgacttggggacacaggctgaactctgtcctctgcaggaactcccttaaggtgctgggccagatctgccataaacagagggaggtagccttctatggccacgccttcttgctgaggaagaaggttcctctcttccagggagtacatccttgccctccctgtttcccagacaagcatcttcacctctcatcttctgatgagaagggtgaggccatactgagctgtcaggctgagctgctgcccttcctcaccttgggctgggagttgatcagggaatggcagttgctgcagagctggatttgagggctgggttctctggatggggcctcctcatgtcctcacccctcaacctgcactattgattgtgttgtgcaggagttagttaaaaagtcattgcacagcctgggcaacaaggcaaaactctgtacaaaaaatacaaaaattagttggatgtgattacacgtgcctgtagtcccagctactccggaggctgaggcaggaggatcacctgagcccaggaagttgaggctt

SEQ ID NO: 6 - DNA, 4334 bp, Homo Sapiens
aaattaaccacgaaaaaaattatcaaaatctactaaataaacattgggaaatatgacctgaatatgatattggttccagaaaatcaagttaactgagctttctcggtcataaaactcttggatttttaaaatcagacaaagtcacaagggtgaagaatttttcccccataaactctttaacatttcaccgaaactgtaagaagatattccagattcaactcaacagtgcccccggagccatcttaatactgcctacaactcattgtgcaaatgaaatacccacccctgctttgtctgtgtctgacgtggtggataagaaaacgcccaagctaatagtaaccaataatgttgaactcctattgtccctcaggtttaagcttccttgcccaacagcaagcaaaatgtttatgaacctctagattttgacttatatttgctgccgttatgtcatgaaaaatgctgtatctcttgttgatctttttaacattatgacttttgtagacgccagctagtaccaaaaacgtaggatgacaggttcccaaaagctaggaattaaaatcagaggcagcgacaagatttaagaaaagcagagaattagacgcagcaccggacccaggatgggcgtggccctggtccgggcgaggaaaagaggaccggtcgcccccggccaatcagagcacgccttgcgctccggcccctggccccgcccccttcctccccgcgccttttcgaatctccccgaactcaacaccccggagcccgcgcgcgtgggaaggggaggggtgggcggggctaacggtccaatccgggtaactccgcccctgcctgactccccctgcgcggacgccccccccaactcccgccaaaaacacctccaggccgccgccaccacccccttcacagttcagcgggtggggcaggccccgggaacaggcccccgggtggtcccgcggtgagctcgccaccgcctcccgccgtccccatgcccaacctgccgccacccacgctgtccgcgcgtccggccgcgaagacagaagaaccctcgtggggcccgggagcgccgcccctcaatcaccagctgcggtcgccaggggacggtcgcagggagggtcgcggccctggctgcccgcagtttggtcctaaagccgctggtccctggggcaccgccccgtcccttcagacaatggggaacccggcggggcccgcagggaagggagggagggagggaggtaaacgagggcccacgccccctattgtctcctcgacggcaccccggagcggacgcccggtgatcgcccagccccctgcccacgaacagccgcgcccccggagagcggggacaaaggcgaggctccgcccgagccacacacaaagcggagcgacccccgcccaccaacccctccgaggcccgcagccccgcccgccgccctgcagcagggggtcgctgccacggcccagcccctcccgccgaccgcgtccctcttgctggcctcagccagccgccgcctcctccgagccccgcacccacctgctcagtccgagccgcctgaccacactctgagcaccaacagacccgggcgcgcacaaaagcgccaaacagaggcacgtgacctccgcgcggggctccgcattggccgagagcggcggcacgtgccgcccccgccccccacaacccgcgtggagcgccgccccccgggaccccgaagcacctcgggaagtgtagtcctgtcccggagggcaggaggacaatgccgggggttgcagggcgcctggggagcatccccaggtgtgggcctgggactaggggggtggtctcgccgtggaagagggcgtggcagtggaccccggactaggtccgaaccagctccccattctcgagaacaagggcagggcggagcaggcggagggcgggggggtccttccctacctttccaaactttggccgcctggactccaccttgtagagccacatgcccgcctcgccccaagggcagcactcggacagagcagtgccccttctagtgcgccacccacatgggtgcctaagacgcccgagcccctgtgacagcacaatgccactccacgcccctgcagggccccctgcccccggcaccctacaccgacaccggcgtgtcacccatattgtgacatcatcgtaatttctaatccactcagcccacaggtcgcgggcgtggcccttccctcactgtgtgcgttcttgccagcatcctcaggttcccgagccggtgaccagggacctgtgcgggaaagcgtggggctctggaatttgatcgcctttggtctaacaaagccactcagcttaaatgcagactccatctgttcttccaagccttctgcggatgataggggaggaagagcaatagccgttctagactacacagattgcagttaagtgttgcttttgttctcagagcacgtgctccccagagcagcactgggttctttttaaaaatcgaaaaaggagccacaaggtcactgttctccctgacctggatagctcagaacctcagcaaaggcacaaaggaaattggtctgaccgtgccttagaataactggccctttctctcacaaaaaggggaaaaaaataaatgaaatgaacatggtccccgcctcctcccattctctgaccaagaccgtgtcctcggttggtggtcaatacaccaagacacctgctttgagatcttgactaagcagaagagatatctttattttattaatgagctgcatctccccaaatcaagaaacaaatgtgaccaaccttcctgaaacaacagtcctaatttagaaagactctcatgcctagttagtcaccagggatgtgccagagataaaatacaactaaggggtgcccaagacaataaaaactggatcatacaagcagcagcacactacacaaagcaaacaattagcaatgcgctgttgcctgaaatatgcttgttgcggcattttttccaacaatcgcccttgtgtggggtcggcctcccccccaagccaatcgaagtggttttcacttagcctgtgagcaggaccaggaataattcagatactgagccttgaaaggcttcttctcagaccaaacttagcttcaaaatggctaggtgcttccgtctgtcatttttctgaacagaatctcagacatcattagaaaagttggagaaggatgggcatgagacccctcaggaaagcgacagataggcaggcaacacaaatgagcaaggaacccaagcccaagaggtccttacccactgaacaggctttttatcttgaagtctttgtatttgatctggaggttcacagaggaaggtcccactcatttaatgcatttttttaagtacaataaattgccacacaaaagtctcacattcctgactattaatgttgtgacagaaaaaagaaataaatctttcaaaacactgataatttgaaagcacttacactgcttccccccacattttctttctccctagagcagatgtctatttccatggaaaccatagcaaggaacgtagatgttagaactcatgttcatttttaatcttttttagcaatgccacttggcttctgggtttgttgggagatgcctggttctgccagtctgtgacaatgttccaagctcctcacagctgcttgaggactgagagggctgggttaaagtttcccctagaatgagcctttgaataaaaaggtgcttttgaggtgggattcctgtccttttattattattattattattattattattattattattattattattatttgacttaaaaaaaattgagacagggtctcactatgttgcccaggttggcctcgaactcctgggttcaagcaatcctcttgtctcagcctcccaaagtgctgggattacaggcatgagccaccacacccagtctgatccttgttctttagggtggggctgccttcccaagagccagatcacagctcattattgtcagcttttgtgggtgtcctatataagccttggaataggaagggctttcaactgtaaggagagacaacagttttgccacttcaccttggagaggggcagaatcgcccttctcgaaagcttcctaaaacgaacttcaagatccactctcttctgaagtggcagcaaggagttaatgttcacatcttggaactgtctatctttgcccataagaattatttttgcttctgctcagatggtttggttggattgttatggagctggctgtgactatggagccacacaacgaagtggagatagggcagtcatccagcttatttgatctgtgtagacagctaaaggagagcacttcaggcttcaa

SEQ ID NO: 7 - DNA, 4528 bp, Homo Sapiens
cgcgcagacctgccaggaagagcacaagaagaaacacccggactcttctgtcaatttcgtggaattctccaagaagtgtttggagagatggaagaccacgtctgcaaaggagaagtgaagtttgaagagaaggcaaaaagtgacaaagctcgctgtgacagggagattaaaaattacattcctccgaaatgtaagaaagggtaagaaaggaaagaaaaaggatcgcaatgctcctagaaggccaccatctgccttcttcctgttttgctctgaacatcgcccaaagatcaaaagtggacacccaggcctatttgtcgtggaaactgcaaagaaactgggtgaaatgtggtctgggcagtcagccaaagataaacaaccatatgagcagaaagcagttaagctacaggagagatatgaaaagggtattgctgcatatcgtgctaagggcaaaagtgaagcaggaaagaagggctcaaagaagaacaaaccagaagatgaggaggaggaggaggagaaagaagatgaagatgaggaggaagagggtgaagatgaagaataaatggctatcctttaatgatgcctgtgcagtgggcttgttttgctaagaatgtgaattctagtacagctcagtattagcttcagtataaaactgtacaaattttcgtatagctcataagattctctgtacagaaaatacttttcttttcttttcttttttttgagacagagtttcgctcttgttgcctaggctggagtgcaatggcgtgatctcggctcaccgcaacctccgcctcccgggtcctggttcaagcagttctcctgcctcagcctcctgagtagctgggattacaggcacatgccaccacgctcagctaatttttgtatttttagtagagatggggtttcaccatgttggccaggctgctttcaaactcctgacctcgtgatccgcctgcttcggcctcccaaaatactgggattacaggtgtgagccaccgcaccctgcctaatgtccctaaatatttaatggtttttaaaaaatttattgtgtatggcagcacagcacacttgtaggaattagtatcaacagtacatcttgcgttttttaagatgctgcattttttaacattttgtaataaaattatgcgtatcaaaaaaacaaagaaattccgtgtgtagttcacactcacagcacatctccgtccaggcacttgagagaatgactaggaggggttcttggaggaggtggtctttgaacggagaatccatcttcaaggattctgtctgtaatggtcaccaagtatttcctgagtcacttccatgtgtcctgcagttctctgaaggggcgtgggacctaccgatgccaattatccagcattatctccagattccaagaagttggggtgtgagccagcaatcagtacagaaaagagataccaaaataagtttgagttggggagtgttccttcaacttcagttttctggaagagatcttttttttttttttgagacagagtttcgctcttattgcccaagctggagtgcagtggcacgatctcggctcaccgcaacctcctcctcccgggttcaagcgattctcctccctcagccttctgagtagctgggattacagacatgcacctgtaatttctactaaaaatacaaaaattagccgggcgtggtggcgcacgcctgtaatctcagctactggggaggctgaggcaggagaatcgcttgaaaccaggaggcggagattgtaccaagatagtttgttccagctaaacaacctggcgctagtgcaggaaaaggtggaaggcacggggctagcacaggagggttcaatattttcaaccttatcaagccatattttggcaactcttgtttttcacgagaagcccccgctgggcttgtcccagcgctgtcctgaggcttcccccatgagttccgatagggcagaggccgccctgagcgtttctctttcccctggtccaagagtggctcaaaagaaggatttttgactggaattggccactttgtgttactttttgacccttgacctcgccccaaagggggatgcgggggaggggctctggtaggggtggccccgctccttccaggtccgcaagcccaggttcccgcccaccgggctcagcccaccctgcggccgttcagggaggccgttggcacccgtgacctacgacccccttcccgagccccaccgaggtcacagccgtggcctcgtctccccatgcctgcttcccgccccctgcccgtgacgggcgtctccgaggaccaatgagcgcgctgtatccacccctcgggcggggccaagcgccgaccaatcgccgctcgggcgcccggccgggtccaaacgctccaatcgtcagcggcggcggggcgggcagagggccggggatggcaggttcaaccaacgggtgggcacgtcgtcctcgcgaggaggcgtgccctgcggccgggcgtgcggtgtccgcggcggcgcagggagggggagggaggtaaacaagatggcggcggcgtgtcgggcgcggaagggggaggcggcccggggcgcccgcgagtgaggcgcggggcggcgaagggagcgcgggtggcggcacttgctgccgcggccttggatgggctgggcccccctcgccgctccgcctcctccacacgcgcggcggccgcggcgagggggacgcgccgcccggggcccggcaccttcgggaaccccccggcccggagcctgcggcctgcgccgcctcggccgccgggagccccgtggagcccccgccgccgcgccgccccgcggaccggacgctgagggcactcggggcggggcgcgcgctcgggcagacgtttgcggggaggggggcgcctgccgggccccggcgaccaccttgggggtcgcgggccggctcggggggcgcccagtgcgggccctcgcgggcgccgggcagcgaccagccctgagcggagctgttggccgcggcgggaggcctcccggacgcccccagccccccgaacgctcgcccgggccggcgggagtcggcgccccccgggaggtccgctcggtcgtccgcggcggagcgtttgctcctgggacaggcggtgggaccggggcgtcgccggagacgcccccagcgaagttgggctctccaggtgtgggggtcccggggggtagcgacgtcgcggacccggcctgtgggatgggcggcccggagaagactgcgctcggccgtgttcatacttgtccgtgggcctgaggtccccggaggatgacctagcactgaaaagccccggccggcctccccagggtccccgaggacgaagttgaccctgaccgggccgtctcccagttctgaggcccgggtcccactggaactcgcgtctgagccgccgtcccggacccccggtgcccgccggtccgcagaccctgcaccgggcttggactcgcagccgggactgacgtgtagaacaatcgtttctgttggaagaagggtttttcccttccttttggggtttttgttgccttttttttttcttttttctttgtaaaattttggagaagggaagtcggaacacaaggaaggaccgctcacccgcggactcagggctggcggcgggactccaggaccctgggtccagcatggaggtggtggacccgcagcagctgggcatgttcacggagggcgagctgatgtcggtgggtatggacacgttcatccaccgcatcgactccaccgaggtcatctaccagccgcgccgcaagcgggccaagctcatcggcaagtacctgatgggggacctgctgggggaaggctcttacggcaaggtgaaggaggtgctggactcggagacgctgtgcaggagggccgtcaagatcctcaagaagaagaagttgcgaaggatccccaacggggaggccaacgtgaagaagtaagtatggcttgctggggtcggggccgggccgggccagtcacggtgctgatggttctgtcttccttccttctctcctccctccctcccttacttcctcttaacaccctgagctggacccgtctggcgcctgtgtcctccgtgccagggagagcgtggttgggggcctgcgttacggactttcactcaggcaaggccagttgtcgcagcggggcgtgcgtttgcatgggctcttggactccagttaaaatgccctggtagcgaaaccctcctgagaagggagcggcccccaatcccctaagactagccccttggctcccccagctgtccaaggagcagaggcgcccagtggaatcagcctgtgtttgtttgggccccgagagtttgtgtgcggccgccaacacgttttctgcgcagtgtgtggccgttaccggggccaggcgaaatgtgatttgtttatcctgtcagaggggaaccctgggctgccaaaaataactgtttgcaccggcttatcagtcagcaggagggaaacgtagcctttcctcatttgccagggatgtgacgctggaagcatccctggcccccgggg

SEQ ID NO: 8 - DNA, 4616 bp, Homo Sapiens
tgaaatggccttattctcttttagtttgtttaagccaatggagccttactagaatgtgagctacaaaacagtagagctattctctattcaatgctgcatctgtagggcctagaacagcacctgaaggactggcggaggcttaataaattgttaaaagggcagactagccaggtgtgatggcgtgtgcctgtagtcccagctacttgggaggctgaggcaggaggatcacttgatcccaggatttctgggctgtagtgtagtataccagtcaggtgtctgcactaagttctgcatcaacctggttgcctaaggatggttgaactgacccaggtggaaattggagcaggtcaaaactcaatgctgatcagtaacagggtcgcacctgtaaatagccaccgccctccagcctgggcaacacagtgagatcccatctctaaaataaattttaaaaataattaattagaaaaaaaaaccagcctgtaatcccagcactttgggaggccaaggcgggcagatcacctgaggtcaggagttcaagacaagcctggccaacatggcaaaaccccaatctctaccaaaaatacaaaaattagctgggcgtggtggcaggtgcctgtagtcccagctacccaggaggctgaggcaagagaatcgcttgaacctgggaggtggagattgcagtgggccgagatcgcgccacttcactccagcctgggtagcagagtgcgactctgtctcaaaaaaaaaaaaaaagaaagaaaagaaaagaaaaagaaaagaaaagaaaaaaactgggaggcctaagcccattcttggtgtcctcacactcttctgccccatctccttgcacccagtcttcccctgcaatctgtgctccatactagccctcaagccctcaacgtgacctagtatgagaactggattctgtcactctcctgctcataatattttatgccttccctttgcccagaatatcattctccctattgtttttaccaatggaactggtatttcttcaaggacatgatcaaatttgcctacttctatattatcttctaaagcagaattcatctctcttccctcaatatgatgatattgacagggtttgccctcactcactagattgtgagctgctcagggcaggtagcgttttttgtttttgtttttgtttttcttttttgagacagggtcttgctctgtcacccaggccagagtgcaatggtacagtctcagctcactgcagcctcaaccgcctcggctcaaaccatcatcccatttcagcctcctgagtagctgggactacaggcacatgccattacacctggctaatttttttgtatttctagtagagacagggtttggccatgttgcccgggctggtctcgaactcctggactcaagcaatccacccacctcagcctcccaaaatgagggaccgtgtcttattcatttccatgtccctagtccatagcccagtgctggacctatggtagtactaaataaatatttgttgaatgcaatagtaaatagcatttcagggagcaagaactagattaacaaaggtggtaaaaggtttggagaaaaaaataatagtttaatttggctagagtatgagggagagtagtaggagacaagatggaaaggtctcttgggcaaggttttgaaggaagttggaagtcagaagtacacaatgtgcatatcgtggcaggcagtggggagccaatgaaggcttttgagcaggagagtaatgtgttgaaaaataaatataggttaaacctatcagagcccctctgacacatacacttgcttttcattcaagctcaagtttgtctcccacatacccattacttaactcaccctcgggctcccctagcagcctgccctacctctttacctgcttcctggtggagtcagggatgtatacatgagctgctttccctctcagccagaggacatgggggccccagctcccctgcctttccccttctgtgcctggagctgggaagcaggccagggttagctgaggctggctggcaagcagctgggtggtgccagggagagcctgcatagtgccaggtggtgccttgggttccaagctgagtccatggccccgataaccttctgcctgtgcacacacctgcccctcactccacccccatcctagctttggtatgggggagagggcacagggccagacaaacctgtgagactttggctccatctctgcaaaagggcgctctgtgagtcagcctgctcccctccaggcttgctcctcccccacccagctctcgtttccaatgcacgtacagcccgtacacaccgtgtgctgggacaccccacagtcagccgcatggctcccctgtgccccagcccctggctccctctgttgatcccggcccctgctccaggcctcactgtgcaactgctgctgtcactgctgcttctggtgcctgtccatccccagaggttgccccggatgcaggaggattcccccttgggaggaggctcttctggggaagatgacccactgggcgaggaggatctgcccagtgaagaggattcacccagagaggaggatccacccggagaggaggatctacctggagaggaggatctacctggagaggaggatctacctgaagttaagcctaaatcagaagaagagggctccctgaagttagaggatctacctactgttgaggctcctggagatcctcaagaaccccagaataatgcccacagggacaaagaaggtaagtggtcatcaatctccaaatccaggttccaggaggttcatgactcccctcccataccccagcctaggctctgttcactcagggaaggaggggagactgtactccccacagaagcccttccagaggtcccataccaatatccccatccccactctcggaggtagaaagggacagatgtggagagaaaataaaaagggtgcaaaaggagagaggtgagctggatgagatgggagagaagggggaggctggagaagagaaagggatgagaactgcagatgagagaaaaaatgtgcagacagaggaaaaaaataggtggagaaggagagtcagagagtttgaggggaagagaaaaggaaagcttgggaggtgaagtgggtaccagagacaagcaagaagagctggtagaagtcatctcatcttaggctacaatgaggaaattgagacctaggaagaagggacacagcaggtagagaaacgtggcttcttgactcccaagccaggaatttggggaaaggggttggagaccatacaaggcagagggatgagtggggagaagaaagaagggagaaaggaaagatggtgtactcactcatttgggactcaggactgaagtgcccactcactttttttttttttttttttgagacaaactttcacttttgttgcccaggctggagtgcaatggcgcgatctcggctcactgcaacctccacctcccgggttcaagtgattctcctgcctcagcctctagccaagtagctgcgattacaggcatgcgccaccacgcccggctaatttttgtatttttagtagagacggggtttcgccatgttggtcaggctggtctcgaactcctgatctcaggtgatccaaccaccctggcctcccaaagtgctgggattataggcgtgagccacagcgcctggcctgaagcagccactcacttttacagaccctaagacaatgattgcaagctggtaggattgctgtttggcccacccagctgcggtgttgagtttgggtgcggtctcctgtgctttgcacctggcccgcttaaggcatttgttacccgtaatgctcctgtaaggcatctgcgtttgtgacatcgttttggtcgccaggaagggattggggctctaagcttgagcggttcatccttttcatttatacaggggatgaccagagtcattggcgctatggaggtgagacacccacccgctgcacagacccaatctgggaacccagctctgtggatctcccctacagccgtccctgaacactggtcccgggcgtcccacccgccgcccaccgtcccaccccctcaccttttctacccgggttccctaagttcctgacctaggcgtcagacttcctcactatactctcccaccccaggcgacccgccctggccccgggtgtccccagcctgcgcgggccgcttccagtccccggtggatatccgcccccagctcgccgccttctgcccggccctgcgccccctggaactcctgggcttccagctcccgccgctcccagaactgcgcctgcgcaacaatggccacagtggtgagggggtctccccgccgagacttggggatggggcggggcgcagggaagggaaccgtcgcggcagtgcctgcccgggggttgggctggccctaccgggcggggccggctcacttgcctctccctacgcagtgcaactgaccctgcctcctgggctagagatggctctgggtcccgggcgggagtaccgggctctgcagctgcatctgcactggggggctgcaggtcgtccgggctcggagcacactgtggaaggccaccgtttccctgccgaggtgagcgcggagctggccg

SEQ ID NO: 9 - DNA, 4374 bp, Homo Sapiens
ccggcgtagcagtgggggaggggaccggcgagaggggaggaaggaaggggggaggaagggggagacctgtctgaatattgcaataaaaataaagcgagaagaaagaagcggactcacctttatgaggcatcctttctggttgtcacagcttctgtcaagagttttgtttggttggggttttttgtgctgctgttgttgcttgaagaccacaatggtttgaaatgacggtgttttaaaggagttgctggtgagagttttctccacggatgttgctgggttggtgtgtgagagcaattctcagattcctgggaaggagacagagattgacaataaaatgggctgtcagcggctggagagtgagagataaagagtgtgggtgagggaagtggctgcagccagcacacctatgctgattggtgatggctcaagtgtgttaatgtgtgtgtgccggcgcccggcctcgcctccaccgctcctcactggcccattagcgaagcctgacctctgtcatcatcctccagcaaaacacttcctcctgcgcctgaaccagagcgggaaatgaggccgagccacggttcccttttcaaacccactaatcactccgcaacatgcaaatgcaccgctcgctctcacacaaaatattgctttatgcaaagcagcgccggggcctcgcgccagccgattggatgctccctctccccgcctggtgcaattggtccgtttgtttgaatatgaatacacttgttttcggctccgccggtgggtcccggctcctctccccggcgcagggcccccgagcccgggctctggcgctcgcctgcatctccccgctccgcgcacgccgagattcggcgcggcccgccctgctgccgcgaacttgagcggtcaagtgaaggtttctgggttgggggtcgcgcccccactccccctaagctggactcgggactcccagtcctcggagggtgcaagtttctgtgctgtcctttcttgccaactccaggacagcgtggcctgccgccccgcccccgcccgcccccaccccatcccagccggggccccaagacacagagcacagcggcggccgcaccccagcccacctggccccttggaagaagaggaaaggggcgggagcgtcactgggtcctggcagctccattccagctgcggaggccgcggcgaagcctaggccgagaggaggttgccgggccgagaactaaacgaggccagaggcctccccagcccaagcctccagggcctgtccaaatcctccaccccgctctccccgccctttcttctctcctttctcctttcggaagccgcggtgcgcagcggagcagaggcacagctctggctggagaggcccgagtaaacacgccacttactttgtgtacagagggttcttgtgaaaagccctgaagagtcctcaccaaacactcaccaacttctcccacgtgccatttgttgactaagtgcggctgcttttcgcagcgcccgagaggaggggaagccaggggagataagaggggagggggagtggaagcctgggtgggggggcggatgaccaatgctgggagggattctctctctctctctgtgtgtgtgtgtgtgtgtgtgtgtgtgtgtgtgtgtgtcccactggcgatgtcggtatgtcagcgtgtgtcgtgtgtgccaccggtcatctgtgtgtggtgcgtgtgtctccgcaccacgactccctctcctgggtctgctcagtccacggaggcagctccccttcagctgttgccagaaaaccggggaggaaagtaagtaaatggcttttctcttctgaccacacaccagaagtccatttgttgaatgccgcacgattaggacacacctcagtacactccaaaggcgcccctcggagcctgcagttaaggtgacaggagagcgagcggctgcctggtcctgcgctgtcccgagctctctcggcggcttcgggccacggagccgggaaggagaaggaaggcctgggctgctgtacacaccccaggacagggcgagggggaatagggctgaagagctgaggcagggaggctgaaatgaagcagccgaagggtacgctagactcttcttgacttagggaaagtgctgaaagtcagagctcatcaataaaatctgcgcgacctgaactcgctgctgactggccgcgtcgccgcagcccctggcagccgggacagtgaggacgctgcaagccgccctgggccgccgggccacatgtgggcctcaccctctcgttcctgcctgggacccagcagccctgcgaccaaggagcccgggcagggctcccgggaagcaaaggcctccccggccctagccagaggtggggtcgcataaccctctcccctccccgggctggggagggctgccggctctaacccttccccgggagctcgcagcgccgggaggaaacctgggtcagaggtgaaggaggtggcgccgggtgtccaggtccgcggcctcctgggcgaggtttcatttcgcaggagcgcgactttcggaggatgccggcaagtggggccgcggccctgagtcccagaccagcgaaagtcggctttctctttctctctccttttactttccaagcgagcattaaagaagcttggactcaagactcaagtccgctgtgcatgagcgagggacttgcgggggggcgggggggggggaagtgattctgtccgaactggaggcgagtatcatttttacaacctctcaattagcgaccgagtggattagcaccttcttaagctttgcctcggaaagaagcagccgtaatcttgttgctatttccccccagggcactggctctttgaatcagctccttctcccacccctccaacccccatctcgctgcggagaaaagttttaacaaaaaatcagaaaaggcaaggagcgaggagtgaatgccactgacgtcattgggtggggaagggggctccgggaaagactcctggaaactcctccgcacaaacaaaaaacaaaaaggacttggctgcttcccatgtgtcaatatttggggaggggagttcaaccccagaatgaggccgagttttcaaagtttaaggagagaggggtgagagtgagatttcctcgttctctctggactggtctcaaggaaggtgggggtgctgttctacctcgtggggagcctcactccctctgccaagtaccggctctgggggcgaagcggcctaggggtgtgggggccgagactgaggtgcgggcgcggttgccagaggtgtgtacaaaaccgagacaactcgcaggtcgccattttaattgcggctaccaacacgcccgaggcccacttgctgccctccaagacgcgggggggcggcggggattgcgctttaggttctgtctcctttccccgcctccccacaggcccctgttcccccctaccctccgccccctgtggccagagggaggacctctcaggccggcgggtgcgttcccgcgggggccgccggggtcgtcccacccggtagcggggctgtctgcgtggagggagtcccgctgggggaccgtggctcgccagagcctgcccagagcttctagccagtattgatgcgtcaacatgaggtgaggcaagcatctcacccgcaccgatccctggcattcccctgtgcccaccccatcaggccttcggggaggcaaagaagtgcccacttctggggggaagtgcctccagctcccagcttcagaaccaagagcctcccatccggagttctgacagttctgacacctccaaactctctctttccccggtcaagcagaggcgcagcgccggcgcgctggaaagggtgaagactggcattttttggagaaggaaagtcttggcagacacctgcgtcactttgtagtgccccaaacgtctctctttttgcagaccctgggaaggtgggatcccttgtccgcggagctggcaaacgggtccagtgagccctaaaggcaaaggctcccatcccggccgcccagtccctggtgcctcccccacttccaggcctttgtccctctcctttctccagcaacctgccggttcccgctaacccggcagcctcgccgagcccagagcctagaaaagccaagaagatcccagagccgccccgtggcaccttcaggctgtggccactgctcggcttggggggaagccgcggtgccctcgcccttcctcgcctcctgccaaatggccagtgctaggggctccctgggttcagtcctcagtcctcttccgttcgctctgggaggccagcctgtctctctctctctctctctctctctctctctctctctctttctctctctgtcttctccctgcccacccccaaaatacctttaaaataacattgt

SEQ ID NO: 10 - DNA, 2534 bp, Homo Sapiens
aggcaggaaagtgggacagccggggagctggaccccaccctctgtgagccccgctggtacctgatggcatgtggcttggagagggcaggtgacctggcgtggagggccagagggtaaatcctcaaacaagtggcaacaggccaccaacttgaaagggaaaattgtgtagtgatgggaaatgtgtccaacaaacctactgggtgactaattacaaaggctgggctggagcttcagaggctgcttgttaaacacttcattaagcggcactctgaaagctgccacctgcgcattctgggagctcagaggggaccctgagggggaatgaggcctggaggatggaaccatcttcaggtagactgagaaggagcctggatctcacttccaaacacagtctggagctcataggtcagaggcctcaatgggagaaaagctaaaggaagagggtgcagaaaggagtttcagggaattggtggctatgtgactttgagcaaatctcacccctctctgagacttagtgttcccatctctatggtcctgtgtgtgtcacagagacatggtggggattaaattcgatcgtgatatgaaagtgcttgggaaactccatggccctacctaaacatgagttatcctcacctgaaccaaggggggaagttacctggcaggattaggaaccccatcctcctgaacctttatgggctctgtcgaggctgaagcagccaggggctaaagccagtccttagcccctggaagggcactgtgaaagtggatctgatttgagaagccgtttcctgatgtgggcagccatgtgatgccagccccgaacaagagggggcagcctggagcctggaaaggtgccagtgcaggtggggcccacgcccagatttctcctgctgactgttctgatgattcacccccacatcccagcctttttacctttactgcagagccggaaagggtgtggggaagagaggagagggaggcaggtcttgggccctggtcccgccccctgctcctccccacccttctctgggcctggccacccagccaaaaggcaggccaagagcaggagagacacagagtccggcattggtcccaggcagcagttagcccgccgcccgcctgtgtgtccccagagccatggagagagccagtctgatccagaaggccaagctggcagagcaggccgaacgctatgaggacatggcagccttcatgaaaggcgccgtggagaagggcgaggagctctcctgcgaagagcgaaacctgctctcagtagcctataagaacgtggtgggcggccagagggctgcctggagggtgctgtccagtattgagcagaaaagcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctgatctgcacaccctcagcgaggactcctacaaagacagcaccctcatcatgcagctgctgcgagacaacctgacactgtggacggccgacaacgccggggaagaggggggcgaggctccccaggagccccagagctgagtgttgcccgccaccgccccgccctgccccctccagtcccccaccctgccgagaggactagtatggggtgggaggccccacccttctcccctaggcgctgttcttgctccaaagggctccgtggagagggactggcagagctgaggccacctggggctggggatcccactcttcttgcagctgttgagcgcacctaaccactggtcatgcccccacccctgctctccgcacccgcttcctcccgaccccaggaccaggctacttctcccctcctcttgcctccctcctgcccctgctgcctctgatcgtaggaattgaggagtgtcccgccttgtggctgagaactggacagtggcaggggctggagatgggtgtgtgtgtgtgtgtgtgtgtgtgtgtgtgcgcgcgcgccagtgcaagaccgagactgagggaaagcatgtctgctgggtgtgaccatgtttcctctcaataaagttcccctgtgacactcctcctgtctctcttccagttcttggcgatgggctgggagtgggactggaatctgacttagagaccctgactttggacctctgagttagggccctgaactccctaggtggctcagtggcccgcacgcaagactttgagtccaggtgaggccggggtcc

SEQ ID NO: 11 - DNA, 10001 bp, Homo Sapiens
tcaagggatctgcctgccttggcctcccaacgtgctggaattacaggtgtgagccaccgtgctcggtctaacaaggaatcttttaaataaagctttgcggggtcgattagactaattcatatctcttgagtagatcctggtacaactcattacttgcagtattgaatgttaaggtctgtcctttattctgaaattatacctttcctcctttattggaattgaaattttatctttttatgaaatgatagtgatggtggatggtatttgccttttttaatatctttatttgacaaaataaaagtcagcaacctatctcgatttccaattttttgctggtgtttgaaattccaaaattgagacctaaagcatagctctggccttggagagatttccaggagagtcagagcccagaagggagcaggatccaggaggccctcatctcccagcactccagctgagccagccgggttatggaacatcactgagcaattaaaatattatcaacagacaaaaaaagtttattgaatacaaaactcaaaggcatcaacagtcctgggcccaagagatccatggcaggaagtcaagagttctgcttcagggtcggtctgggcagccctggaagaagtcattgcacatgacagtgatgagtgccaggaaaacagcatactcctggaagtccacctgctggtcactgttctcatccaggctgcccatcagcttcttcagcccctcctcatccactttctcctgaaagtgacaggaaatacactcatcaccaagccagccccaaccccagctccaccaaacacccagaccctcacacattcaggttggttcccagctctccctccccactgggcagctgggtataaggtgggcaggaggccctgggagctaccaagagggcccagtgagtaaggagagagacagatactcattggtgagcatctccagtgtgccctcctcctggacacagggaggacactggatgctcctctgagcatgcatcagctcgaatcccacaggagcccagcgaggtaggtatcatcaccccattctgctgatgaggaaaccgaaggttgctgctccccaacaccagccaggtagattcagaaaagaacactttttattttttaagacaaggtcttgctctgttgcccaggctggagtgcagtggcacaatcacaactcactgcagcctcaacctcctgggctccagcaatcctcccacctcagcctcccaagtagctgggaccacaggctcatgccaccacacccagctaattgtttatttttagtagagacaaggcctcgctatgttgcctaggctggtcttggcaaccagagtgatctcactttgtcacccaggctgtattatagctcactgtaaccttgaactcctgggctcaagcaatccacccaagtagctgggactacaagcgtatgccaccatgcctggccaatttttatttttatttttgtagagatggagtcttgctatgttgcccaggctggtcgaactcctgggcttaagagatcctcctgccttagcctcccacactgtggggattacaggcataggccactgcacccagctgaaaaacacttttttaatactagccgaaataattagaaaaatttaaccagccacaaaaacaaaattaaaaaaaggaaagaaggacctgcctcatgtgttcaaagcctgacacctaactttgggaatcaccaatgagtcagtatagggagggtgagggacaaattgaaggtcgatgcatttctccacaaaatgtcccagactatatatcttagctgggcttttctatccctacatactttcttagtttggcatataaaaatggaaagaggtcaagcacagtgcctcacatctgtaattccaatactttgggaggccgaggtgggaggattgcttgaacccaggagttcaagcccagcctggacaacatagcaagactccatctctacaaaaataaaaattggccaggcatggtgacaatactcctgtagttccaactacttgggaggattgcttgagcccaggagttcgagattacagtgagctatgatccagcctgggtgacagagtgagatcttgtccccccaccacaaaaaaaaaaaaaaaaaaaaggagtccgggcacggtggctcacgcctgtaagcccagcactttcagaggccgaggagggcagatcacctgaggtcaggagttcgagaccagcctgaccaatatgatgaaaccccgtctctactaaaaatacaaaaatcacttgggaagccgaggcaggtagatcacgaggtcaggagttcgagaccagcctggccaatatggtgaaaccctgtctctactaaaaatacaaaaattagctgggcgtagtgggatgcgcctgtagtcccagctactcaggaggctgagacaggagaattgcttgacccctggaggcagaggttgcagtgagccgagatcgtgccattgcactccagcctgggcaacaagagggaaactccatctcaaaaaaaaaaaaaagaaaagaaaagagagagagagaacgtgccagtgctgtgtgatcttgggacaatcacttttcccttctgggctctggtttctcaagtctccaatgacaggattaaacagatggactcggaaggccctcacagcacatggttctctggaatgctgcaggaaacagccattaattaagcactcccactcgggcctcatttccactccagtggagccatgaagctaaagtggggagggggctgggccccaccctggcacctgcatcgacaggcacccggaactgggggagagatttaacctgcacccccacactcacaccaggacctcccccacaggcctgtgccactcacccccacaaagctgggcagctccttgtgcagaagttccttcatttcccccttactcagcttgaacttgtcgccctcttggcaggagtacttgtggaaggtagtgaccagcacagccagcgcctgctccagagaactgcacatcatggatctgtggctgcagaggtgccaggtgatgggtacactgctgaggctcttggggccttagctcagcctgtaggatccacttctgccctatgcccccaagccacctcacaaaacccctctctgaatgggaaggcaggggctgcatctccccctcagactgtggttccctgaggccggaggcgatacctccatctcaccctgagggcagacgctaaagcttcccttgtgtctgggagtcaccaagcctcctctgatggcacttgggacacccccctgagggcagggctccccattttagtgtctgccagaagggaaatgacagggtgaccagagtcccattttgatggcatctgcgcaggctctggggagcagggccacatgcaccggctggcagatgggggctcctgtgcagtctggcaggagccatggctacagcctaggagcaggaagctccctgaaggagtcgtttccctccttagactcgggactcctgaagccagaggcatctctctctgccatctaactggaagctcccttgggcaggagtgtttcctctctcagactaggagctcccagagggtggggaatgtgtctcccctcaccctgaaggcccctgagcctctaggcagacaggggcatggatagggtgggggcaacttaacattctctccaccaggaaggatcctgttggaattagaattaaagatatgaaatgttcattgccttgggatcaggatgggacagacctcagcggcaaggcctctgagaatactcagaccagcctggaaaggttaggcaggtttcagggtgaggccagaggagctatgccagaggcagggcatgccctgggcccatcatgccagccctgccttcaccgaggcagggggcagagctttgctgcttggggccatgacccaggcagagtcttgagacccctgcctcttgcaccttagtcctgctagaatccaggactttgcaaaaaaaaaaaaaaaaaaaaaaaaaaatctcaggattctttttgcagcaacgcccacatgcacacctcctgctcctaggcctagacccccaaagaagggcccctagactgagatatccaggggagggcctcagagcaacccctgcactgagacctcacagaggaacctggagaaaaacccttcagtcggccgggcgcggtggcttactcctgtaatcccagcactttgggaggccgagatgggtggatcacgagatcaggagatcgagaccatcctggctaacatggtgaaaccccatctctactaaaaatacaaaaaaattagccgggcatggtggtgggcgcctgcagtcccagctactcgggaggctgaggcaggagaatggcgtgaacctgggagggggagtttgcagtgagctgagatcacaccactgtactccagcctgggcgacagagcgagactccatctcaaaaaaaaaaaaaaaaaaaaaaaacccttcagtcaacacttcagcacttcacagagagttcttccaagggggaaggcccagagaggcccaggttgatcccaccagggaagctggaatgagagaactgtggagacaaagacagagacccacggggatcctccccaccctgccctcagcaggacagaggtactcaccagaccaggtggcagagacagacccaggaaggagagcaaggcagccaggctcccagggtgaggatttatatgtgggccccactggcccccaacttggcattttaaggaaaccaaacctgcctcaacctgatcccaccaaaccctggcctcttgccattcccactcattccctcccagccccctccctcccagagagtgccagctccaccaccagctgggggagggctctaggccaggtcaagggcagcccctgagcccacccaggccacagtgggaagtgggaggtgtcgtggggactgggcatcctggaccggggtgaggggaggcaacccctgctctggggcctggagactggtgccaggcctcattctcatgacatgcctgtgagtcacagcccactcctgtgtgagaggctgtgagcacacgctgagacttcatggtccagtgctcgtgtacatacatgcgcctgtgtgtgtgagagagaagcaacctggggccacccttaggaagctgggggccagaggaggcagctgggggacatcaggaggagaaggacaggactgacttcagggcatggatgaagtggagtgacttttaatggccagcaccagaatacctcttaatgaggtaatgaggtaactaagtgtgcttagaaatacctgggaaggtccctctgtgtaggaaggtgtctggaaggatggggaagcagtgagaaatggggttgctctacacacagccgcagttgggctgggccacagtctgtggggagcataaggaagtcccaagtagttaaaggctgaacaggaaaactttggcctcctcttctccagcttgagggctgggtgggtgggtaggggtacatccctacccaaggctgaaaacaccagctggacagcttcccaagccagaatccaggcctgaagcacagccctcagccacagccctctctcactgccccccacacacatgtcctccccagacccggagaaaggcaaacactgtggccattcagagcccagcccaagggagggctgccccctcccagggccccttcctccttggccctttgtctatcccggcccgtctgggcatcagggcaccgcccttcctgtggccccagctcccctccctgctccagctgtcgagtagcttcttcccctcccccagcccctctacctcagccctaagtgactcacccgaggttccaggcccagatgcccaggcagtgactcagcggcacaccctcctcccccagggccagggcagcagcagtcccagagcagtaggtggaagccccagcccagcctggcagggaaagcactggcacagagaccccaaacaggccctgccaggaggagctttggataatgacatggcaggaggatcagactgagaacaggctggtcccttcctagcggtcaccgtgtgacttgggggccagcctgagcagtgtacatgaagtcaggccttggggcccccagtgtcctcttctacaccttggcacagccaccgagtgtcccttgctcccctcagtacttgaacccctcatgctacttgtcttcccatcgaggcctacttcaagtagaactcggaataaaaacccttcacactgagggtgagggacaagggagcgcaatgcatcgattttcacagccattctttccttttaactaagggcctccacagggccttccctgctcagaaactgcagtgcatccccatggctgtcccttaaagccaggcggtatgttctcactcataagtgggagttgaacaatgagaacatatggacacagggaagggaacaccacataccagggcctgtgggcagttgcggggagaaggatgggggcaaggggagggagagcattaggactaatacctgatgcatgcggggcttaaaacctagatgatgggttgataggtgcagcaaaccaccatggcacatgtatacctatgtaacaaaccacattctgcacatgtatgccagaacttaaagtaaaaataaaataaaattaaattaaaattaaaaatttttaaaaagcctggcagtgaggcgctccagactcggcctgctgctgcgtgtcccttaaacacaccggcacatgcaactagtgtggccaagaccctcggcttgcgctgacccctctgttcagaacgtgcccacacatgcccatgccctctatcctgctgaaatccaacccccccttcaaaggccactgcagggagccttcccagggcccaaccggattcagtgtctacctgttctgtcctgtacaaagcgccccttttgcccttttcgtgtgtacttagagaattctgattttgactgaatcacctgtgtacttgttttctctcagcctcacccccacatggtgagctcaccggtcttactcatttctgcatgaggtaagggtctcgcccacaccaggtgccaaccagtgcttacggctaccacatggcaacaggggtcactggaggagtgcttaggagcaagggagtccttctcaccccgtgaaatcacaccactgactatgctacgaaataatcacctctcctctggatcccaagagtggaaccgagacaacgggtcggaaaagagcttcagagagctacaaatccctgaggagtgacagcaggaaactgcggctcccaggacccagtgagggagttgagcaaaccccccagcgggcagagacggagacaggcaggcagacgaagaagacaaagagtcagtcagatggaaaagccagggagaaaaacagagacagcagcagagccgcgggtcactagggtcagctcctgaaggcctgtccttaatcaggtgtctctgtctcaggaactgaggctgcgactgcgcccatcaaatggccatatacctgagactggtgataatcgtattcatttgccactaacttgctgcgtaaccttgggcaactccctcccccacggcagggcaggagagttgtacggaatggcccctagagtccgatcccaatcccactctcacattctccagctgtctacaaaggcagagtagtcaagacacaagcaggccctgcggacatccaaagcagtgactctgccccggcccagcctcaggaagctgggtcctcacattccgtccaccccatctccgggctccaggtgccagaaattttccaccagcggccccgcgggattttgcccagctgcttcgtgccctctggtggctaaggcgtgtcattgcagtgccggcctcctgtcatcctccctttcttgtccgccagaccctctggcgccctgcttacgactcaaacaggagacagtgctgattcatttccaagcggccttcctacacccacacctgcttcacatagatgaggtttcccggacagtccctgcccagaagcccaggtggatgtctgagacggcagccagatacctggaagccattttaaaagcctagggatatgggtactcgggagataggaggcggaaagaccacttgagcctaggagtttgaggctgcagtgagccatgatcgtgccactgcactccagcctggacgacagagcaagaccctgtctcaatcaatcaatcaatgcaagcctagagataagggcaggagaaaaccaggggacagaagtgagggattggccactgccaagttctgcccacccaccccctttccccaggccgttcaggggaaagagaaatggcctcattgtgggggccacaggtttagtttaagtcctgacattgcctctggcttactgtgtgactgtcgaccttggttgagtggtgccacgaacctgagcttaaacgttttcagcagaaggaccccctttattatgccccgccccacaaaataagttctgaggtattctgtcttagcaaaatgcattaaataatttatttcccctgttgtactaattggatccataagtgtctcccggcagcatgaccagcatgcgaggacccacgttatcacattgggttcaggtcatcctggatttgtcactcacaatgggcgtgtgcatatcctttgctggggggtgcagactgaaattttgaagcactcgctgtgcgtcaggtgctctccgtacattaccccatttaattcacacaacaatcccaggagttggaataagatgaccccacttcacagaggagaacactgagactcaaagtctgccaaattcacacaattagtaaggggtggggaggcatgacgaacacaggtggtcacaacgttaaacctttcctagaagctccaattattccccgataaccctgagagccctaacatttcatttccattcagaccagcctcagtctctctgcccatcctctctccaccccacactcagcctatctgtctcatttctcaacctcagcaggcgccagaagcccatcttctccccatctctgattctggcatcttttcctcttgccttcaaatgccctgtggactggattctttttaatttttgtttacttacttatttgagacatagactcactgtcgccaaggctggagtacagtggcaccatcacagctcactgcagcctcatgtgatcctcccacattaacctcctcagtaactggggctataggtgtgcgccactgtgcgcatctttttgcatcttttgtggtgatggagttttgccatcttgcccagacgggtcttgaactcttgagctcaagcaatcctcctgcctcggcctcccaaagtgctgggataccaacgtgagccaccatgcccagcctagcccggattaaatataaatataaaagagactgggcatggtggctcacacctgtaatcccagcattttgggaggctgaggcaggcagatcacctgaagccaagagttcaagaccagcctgcctaacatggcaaaaccccatctctactaaaaatacaaaaattagccaggcgtggtggcacaagcctgtagtcccagctactcagggaggctgagccaggaaaatcgcttgaacctgggaggcagaggttgcagtgacccgagatcatgccactgcactccagcctgggtgaaagagcaagatcctttctcaaaaacaaattaaaaatgaacatgccacttaacctaatatttctactgccaaacatttaccttatgttgttatttttccaccagtatgtaggtatacaaacagatatttgcaagaaggaagaaatggacataagaaaaatttccatcaataaaggattgggctgggcatagtggctcatgcctgtaatcccaacactttgggaggccagggcaggaggatcacttaagcctaggagttcaagaccagcatgggcaatataatga

SEQ ID NO: 12 - DNA, 4449 bp, Homo Sapiens
ttccttgcacatctgagaggtaagaggaggtgtctgtggcccccctgacacatacgtgacatatgtattattacggctcatgtgtgtgctgctgtgtgcagggggcagggggcttcccgttcctgatggttcttcttggtgggtgtctcccggcctctcaggcctctttatctgctgaacgtggtagccaagggtttgggaatgatttgccagactggttaatgtggaaagagctggccccgctcagttctgcacctccctcttcctccctggaaccgtctggctgcagagagcaggagctttccagagctcccgggggatcccatctccagtataactgtgcaacgtgtgcccagcacaagagcaccagatggagggacaggtgggaggaggaggaacccagggtgcatttagcttggggcttgctgagctgaggtccccagagcaaggacgactaggttggggggacaccctctcccaatccttgccaagctacagaggggccagtgggaataaagtgacattttggcttctgtatccctcctctgctgttctattttctagttcgttcagatctgaggttggggaggggttttcctggaggggtcagtccatgccaccctctgcaatttttattacacatgctttcagacattctgctacaggtttcatctcctacgccaatttctatttgggaaagcaaataaacggaaagctaacttgtgtcacttggtcgctggggcatccgcagtgagtagttaagaaatgccaggggagtcggtgtccattttcatgcctggacaagagtgcgtcttggacttgcgtcctgctgcacaccccaccgtcccgctgcacaccccaccgtcctactgcacaccccactgtcctactgtacaccccaccgtcctactgcacaccccactgtcctactgcacaccccactgtcctactgtacaccccaccatccctgctttctgcactcagctgcccacttgtatcccagctcaggaagcccagaagatgcagaacctctgcgagagcccagggtgaaacgctgcgcttcactttcaaagaaaggaaaatcattcatattctttaaaagaatgaacagcacagattaatatcgatctcttttaatttttaggccaattttgagtagtcaaagtcagagcagtcaatctgtgttgtgagccgaggcacagctgcagaagcgtgtctgaggtgtccggtggaggtggcagccgagctctgggactaatcaccgtgctggggacggcaccgcgtcaggatgcaggcagatccctgcagaagtgtctaaaattcacactcctctacaggggtgagggggagggagaaagagatgctttagtgaggataaacattttctttcacatttaaacaattacagagtttttactttaaagtatccataggcacattctttagaaaacatgaactgtcagccgggcacggtggctcacgcctgtaatcccagctctctgggaggctgaggcgggcagatcacctgaggtcaagagttcaagaccggtctggccaacatggtgaaaccccgtctatactaaaaatacaaaaaaaatttagctgggcgtagtggcacacacctgtaatctcagctactaggaagctgaggttgaactcaggaggcagagattgcagtgagccaagatcgcaccattgcactccagctcaggggcaacggagcgagactccatttcaaaaaaaaaaaaaaaaaaagaatacatgaaatgtcttcagatttcgtcatgccttccccctctatcctaggcaagctagaaagcgttaccaacagtggctcttcccaggcttttggttagagatgtgaagagaagccggggggaaatcaggtttcttcccaagtcccttagccctgcctttctattcctggacctgaatgcagcctgactcaggctaccccattgcaccaccactggcggccgtgactctgtgtaaaggcatagctggtgatgctgatcagagcctctgtagtcttaaatgacttttctaactaattctaaatcttcagaacccatcgtataaaaaggccataccttctggagggacgtcgatggtattaggatagaagcaccaggggaccccacgaacggtgtcgtcgaaacagcagcccttatttgcacactgggagggcgtgacaccaggaaaaccacaattctgtctttcacggggggccactgtacacgtctctgaaagtgcacaggtaagaagcaaagtaagttgtgggctgaattccttgatgttatcatgcacacacccatccagcttccttctccaatgacatcagcaactgtccagtgaggcggatataaaaccctcaggacatgagagggagacgtggtcctcacatcctgatgtgcaaacattacgctcagggaaaatgcaaggtgccccaggtttgtggactttgcatctttctaggtaacttatttattcactttttaatttcaacaaatgattattaaattttactcaatacataaatatttactgagcaccatttgtgtgcatgagaagtgggagctagcatggcaaaagccaggcactgtgccaggtgagagagacccagaaattaaaaccagagaagtcattaataagagtctaaatatctgggcccaggctcatgcctgtaatcccagcactttgggaggctgaaggaggtgaatcacttgaggtcaggagttcaagaccagcctgaccaaaatggtgaagccccatctctactaaaaatacaaaaaattaggcgggcattgtggcacacgtctgtaatcccagctacttgggaggctgaggcaggagaatcacttgaacccaggaggcagaggttgtagtgagccaagatcgcaccattgcactccagcctgagtgacagagcaagactccatctcaaaaaaaaaaaaaaaagagtctaaggatctgatggaggagaaaggcaagaacatgtgcgagacaacgcaaggccatcgtcccagggtgcccagggtaaccacgggggtagggcactccccggagaggccaatgacaagcaggttgaacaaagcaggggggctccctgcaggaggaggttcaccaggtgaagatggagccgcatgggcaaaggccattccagagacccaggtgtgttcaggaggtggaaacccattgcaggtaaggtgagaggaccgggtggggtggtctaggaggagccgacagagggtacaagctgtgaaacagcttgaagcagggcagtgaggaaagggatctagaggaggaagacacgtggacagatggggctggctgggggctgccgcaggatcttatgcaagaggttctaacaccagagcttcaggctctgagctccgcggaatcaaaggtctcagaaagcaacctattaggatctggtggttgacagcctgcagcagggggtgaaagaggagcccagagcaccctccggtccctgtccctgccttggggcataggaggggaggaactcagtctggccacactggctcaggtgagggcgccccaggggaggccgagaggggctgttctcttgtctgctttgctatcagggactgcctcgagatgtctttggagaaagtgttcctggcttgctgggaaggatccgtgttcagctcccgctgcccagcagcttccatgggaaccttgccctcctggggtctggatccatcgcgacgtgaaggtgatcatcgcccacccccgggacactgtgggggtcaagagaggccccgtggtgagggaggatcatcatcctgggggtcgggggggtttcctcctcagggaggaagatttccagccccggtgctctgcctccggcagactctgtcttgcccacccgctttgtctttgtcgcatgatggaaataaatggaaatggtttccacacacgaatgcactaaactgtaatcacaattttctagatttcagttgtaacaggatcatggacctgagtgacccgcaaagacgctctgagccttgagccagagggtgtgtggggtggggaggggagtttgccacggcctctgtgatcccacagcacagggggcagagctgggggctggggtgggggcaagggcgcaggcagatgggcctgggggtggccagcacggggacccacccagttcgttctgtacaccgaggccacttcctctctcgggttccaaagctcccccgctccctgccatgggcttgggggtcttcccactgcagcccaatgctggctgctcttctacgctgcccaagcccacccctcaggcccggtaccccacagcagagatcaagaggtggctggagggcagtgggggcacggacagcaccactgggcgctccctcttcaggcctctctggaaacccttgctttggaaacgtagaaagccctttctcctgcccccacctt

SEQ ID NO: 13 - DNA, 4296 bp, Homo Sapiens
agaaacccacatacttctccattcttaagaaaaggaagtagtggtgacatcattctcggctaaaatgtagtctgtttatatctcaaatattcggtaacaatgttttctccagagttatgaagcaactagaacaatcaaatacaattttcttctaaatctttattgcctgattcattcattcatccaacaaatatttattaaacatcgattatgtgtttgatgcttagggacacaatagtaagtggagggaaagatacataatacctgccctcaagaaatttggagttgagtggaggatagaaatataaattaaagaatgacacaaataattataaagttacagctgttaaaagaaaagcatatggtgccaagagaacgtgtaatacaagatctactcatggaggtgagggaaagcttgcccatcaaagaagttatgattcaatccacgaagaccaggagttggctgggtgaagaaaaaaaggtcagaggaaggaagtccacactggggaaggctctaagcataaagggtaggaggattacagaggcatattcacgaaatttggagaaggctttcagtaagcaaggagaagccaaatgaaagtttacgggagagttggaggcttgaagacacgttcaaggatctggtttttatcttctctttatctcaagagcagtgggaagccattaaatgattttaatcagagggttggtataactagttttgtattttgaaaagctgaattcagctctcgtttgagaaactgagtgaaagagcccagaacggccgtggctgagggtgactcgtgggagactcctacacaagccatggcagtggcatgggctggtggcagaagagggaatagggagaagatttggaactcaatcttcctccattgacaaagtcactccagctttggcaaggcaattaattggtgggaaagaagatgcctagccctcctgatttcactgcactttctgcatcttcaacatgagtactgggaagtggcaaaacatccagaggcagcttgggtgctaggtggagcatgagttaaaattccaggatgaagcaaatgaacacttagaatgacaggaaagatttgggagttgggtttgggggagggctatttacctttattccctggagaccctggcacaaacccttgcctctgcaatcttcctctcaggtaaaggaattcattaaatgaattgctagaagatctactgaccagagggctgtacagaatcatatctttgagagtgggaagtaggttgatcacatagtttattatccaatcaggacatatctgaaagagaaagggggttctattaatatttaaactacaaaacatgtacaccaggaatgtcttgggcaaatctggttgccctagcaagaaaggaaatttgaaagtttatactgttctgctcccatgttaccccgtttgcacatgagagggtaagtattctctttcttcacctgcattaagggaataaaagcacaagcattcaggtgactcccaacccacttttaattttacagtttctgctatactctatacattctgaaaattacatttcccaccactatcacttcgtgataggtgatcatttacaattactcactgactcagtcccgggaagaggcggtgcaaaatgggacgctctatccaggtgctcattagaaatgcagaatctctgcctgcctcctagacctactgaattagaatctgcatttttaaataagatttccaggtgatcaatatgtacattaaaacttgagaaaaacctctagacttcgacctaaagaaaaacattttacaacttgacagtgtatgcacatacatacatgcatatagacacaactgaagcacaaatttaatgaagtagaatttaccgttactattttatttgggaaagaaatgtgctcgcgactcaatagattggagtattcactcctggatctcaacttgcaatttgaaaacgcatctctaaagcacctaggagcaatctgaagaaagctgaggggaggcggcagatgttctgatctactagggaaaacgtggacgttttctgttgttactttgtgaactgtgtgcacttagtcattcttgagtaaatacttggagcgaggaactcctgagtggtgtgggagggcggtgaggggcagctgaaagtcggccaaagctctcggaggggctggtctaggaaacatgattggcagctacgagagagctaggggctggacgtcgaggagagggagaaggctctcgggcggagagaggtcctgcccagctgttggcgaggagtttcctgtttcccccgcagcgctgagttgaagttgagtgagtcactcgcgcgcacggagcgacgacacccccgcgcgtgcacccgctcgggacaggagccggactcctgtgcagcttccctcggccgccgggggcctccccgcgcctcgccggcctccaggccccctcctggctggcgagcgggcgccacatctggcccgcacatctgcgctgccggcccggcgcggggtccggagagggcgcggcgcggaggcgcagccaggggtccgggaaggcgccgtccgctgcgctgggggctcggtctatgacgagcagcggggtctgccatgggtcgggggctgctcaggggcctgtggccgctgcacatcgtcctgtggacgcgtatcgccagcacgatcccaccgcacgttcagaagtcgggtgagtggtccccagcccgggctcggcggggcgccgggggtcttcctggggtccccgcctctccgctgcgcttgacagtcgggcccggcaacccggcccccgggcggaaacgaggaaagtttcccccgcgacactcacgcagcccgactcccgtagctgcagggattgtgagtttttcttgaaaaagagaaggaaagttcagttgcaaggggcgcggggcacgtttggtcccctttgtgcgagcaggaaaggcgttgtgttggccgcgttcgaggcgagcccccacccccggaaagggaagtttgagaagttggttatctgaaggcggccggggagcagcggcccggagcggcagcctgagctgccaaagcagccagcgcacctgggccactccgcccatggcgatgccgcgtgcccacccagctctttctgagccacccgttcaaaaggccagctcctcagtccttagctcctggagacggccacgctttccctcaggccggcttcttggcccggagtttttggaaacaagtttcaagaaaataatcgatttccaaaagaaagttagctggctccactgacgccttggcatggatggatagggagtggagatgctcaggtgaaaccgagaatccctcactgaatgcctactgggtgctagaggctgtagattttgcctggaacaagatagtcctgtcttcagggagttgatggttctatgcaattatcgtttgttggaaaccgaagggttaaaatcctaactaggctacccacctgatcgctgtctctgaaggtttttaaggaaaaaataaaaataaaaaaatatatatatatattatatatatataaatatatatataattatatatataaatatatataatattaatatatatatgcatgcaggaatgggggttcttaactatttgttatggaaagtgtaaaacctctgagacttcaaaagttagattttttttttttggagacggagtctcgctctgtcaccaggctggagtgcagtggcgcaatctcggctcactgcaactttgcctctgggttcaagcgattctcctgccttagcctcccgagtagctgggattacaggcgcgtgccaccacgcccagctaatttttgtatttttagtagagacggggtttcaccatattggccagggtggtctcgatctcttgacctcgtgatccgcccaccttggcctcccaaagtgctgggattacaggcgtgagccaccgcgcccggccaaaagttagactttttgcagctatgatccaaataacagtatctgcagctgtggtctgggtaaccgagtatttgggcaagtcatagagctttttctgggccttagtttcctcatctgtaaaatggccagcttgaatctgggtaattttacatcatcttcatgtttaacatcttacgtatcgtgcccctcccctcctttcccctggctcttctggtgacttggagatgacccatgtagactttggatgaaatgtagaggagttgacagtccacatcacccggaggcactcattttatttatccagggacatgggca

SEQ ID NO: 14 - DNA, 4001 bp, Homo Sapiens
acgcccagctaatttttgtattttttagtagagacggggattcaccacgttggccacgctggtctggaactcctatcctcaagtaatccgcccgcctcggcctcccaaagtgcaggcgtgagccacagcgcccagcctgattccattctatatgaagttctccaacaggcaaaatggttatggagatcaaaataaaggtggggtcgggaatcgactgggaagagacgtgatgaaacgtttctgggacgatgaaaagggtctgtgacttggtaggcatcacggagcggttaggggccaaaactcatcttcctgtgcacttgctgtgtgcactggcgctgtgtgtaaatgccacctcgatttaggaaaaagatgacgtaagtacggcacaaagtggccggtacgcggcaggtgcatgggaagaaactgcggaatgaaacaaccgcgagctaagagatggggcagcgggagaaatgaattcgagttccgcctcctaccaggaagaaccggctcgggccggagggctgcacggaggaccacacggacgcctgcgggcccgccccttccgcttcacgacgttcagcctgcgtctggaactggaatggcctagcccaaagctagataacaggtagattgtttttccgacaaattatcaaacgacccatcattgcactctttcaaaatttgattctcagacgtacccattctttttttttttcctccgggaagatgagatatactcattcttgaaaatacctccgggcttgccttctgcacacttctttccctccctgtctcacgccatggtagcgtccgcctaggttgcaggcgacccgcggggtggggcacaccattcaaagaaggggagggattgaggtttgcatcaaaacaaatacccctgcctttgcaaaggccataactaagtaatccagaaaaagaaatgcaggcggagaatagcagcctccctctgccaagtaagaggaaccggcctaaaggacattttctctctctctcctcccctctcatcgggtgaatagtgagctgctccggcaaaaagaaaccggaaatgctgctgcaagaggcagaaatgtaaatgtggagccaaacaataacagggctgccgggcctctcagattgcgacggtcctcctcggcctggcgggcaaacccctggtttagcacttctcacttccacgactgacagccttcaattggattttctccatctagcggagccgggggctgcctggaaagatcgctccaggaaggacaaaggtccggaagttgtgggaccttagcagcttgggctccccggatcacccccaaatgatcatttcggaatggagccccagttttcactaggatgccatgggctctaaaatatacagctatgagttctcaatgtttcgagatccaaaagtctcagacctcaatgctttgtgcatcttttatttcagggattccctacgcccagcaccgggtggatgtgcaaagaagtacgctttaggccggctcaaggttccccaaagctccactcctctgcctaggcgttcaactttgagttcggatggtcctaacatccccatcatctacacccaggtctcccaacaatgcaactcctatgatgatccctctagccaagcttccatcccactcacccccaaactcgctaagtccccactgccccacccccagccccagcgattttcccgagctgaaaatacacggagccgagagcccgtgactcagagaggactcatcaagttcagtcaggagcttacccaatccagggaagcgtgtcaccgtcgtggaaagcacgctcccagcccgaacgcaaagtgtccccggagcccagcagctacctgctccctggacggtggctctagacttttgagaagctcaaaacttttagcgccagtcttgagcacatgggaggggaaaaccccaatcccatcaacccctgcgaggctcctggcacaaagctggacagtcgccatgacaagtaagggcaagtaatccgcctgccggaggaagcaaaggaaatggagttggggaggagggtgcagagtcaggattctcgccgacctggtgccgtagatactaacattttggggtggaaaattctgcaagccagagctgtgagggcagaattggtggaaatcattttggaggaatcctgcattgtgtcaaatatgaagggtggaaggaagaaagcttttgcgtttgctctcagctggatcctttcttctcatcagttaaaatgtcattttttaggaaggctttccgtaatatcacaccctaacgttttctcccagatactttatatcacaccatcttatttaatctccttcacaacccttatcactctgataagatttatttgttcattgctttcagtacatggaaacgtaagccttatgaggatatagaatttttctactatcttattcattgttgtattcctgagtgcctatatcagtgctgggtagcaagtaagagctcgataataaatattttttgaatgagggagacaggtctgaagcctggagaatgagatgcagaagaggtgcaagacctgctgcgccctctgcaggcggcgggggggcggtgcaggtgctttaagaattaccgcgggactcggtagggggagcgtaggcgcttctcgccaagatagaagcgttcagactacaactcccagcagccacgaggagccctagggcttgatgggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacacgtaagtggtgatggcagtggagtgtggagtctggggagatgaagtgtgaggtcgatctgtcctctggtcctgagacccacttctccaggcctctgccccctttgcttggcgacccaggtttattgtcccccatcttcctttcagcgcttggaactacagcttctcccagctgcctcgatttctcagtggttcctggtcagagttcagcacccaacctgagaacttcttgaaaggctgtaagtggtaaggataacaacggggcagggagctgaccacccccgagattttcactgtaaaacagtccagttttctaggagagggatgccccagagctgggagaagcggcacgtagcccttttagactgagcttacattttatctagcagtttgtgtcttctacttccctcaaggattcaggggggcttacctaccccagaggcaggctcagccctagccctacacttgaaaagcataggtctggccagctttctaactctcccctgtttctagggctcctgacg

SEQ ID NO: 15 - DNA, 4607 bp, Homo Sapiens
tgccacccatggaacgaagacctcaaatcccagccatgaggacaactacttccttacctggggatagaatactagtatttaaatcatttattcggcatgtggtagaggagaagagaattagaggagaagtagagatgacaaagtagccacaccacttaccagtttacaggcaacagaatcatcaatttgccttttgtgacaaagtaacaacaaagagccgacatctcctataccctcacctgtgtgcagtcggcactgccgatacccacctttccaagggcacctccccagaccccccacctgtctacggtatcttcctgggtcccgcacctgcccgggcacctgccggggtcctgcacctgtccggcccccatatctgcttggggtacctgcctgggccccgcacctgcttggggtacctgcctgggccccgcacctgcttggggcacctccccgggccctccacctgtctagggtatcttcctgggtcccgcacctgtctggggcacttgctcagacactgcacctgccccgggtacctgcccgggccccgcacctgtccgggcaccgcacctgcaggatccccaagctgcctccacccacgcggccgcccccggccctgcccgccggggacgctggcaccgaggatgtcctgcccgtggcccaggtccccgccgctcaccaggtacttgccgtccggggagaacttgcagagtaagctggagagcttgaatacctcggagaagttcatggccgccgcctgccgcgggcgccaccctgcgcccgaaaacccgcgggacccctgggcgcgcagcaggctgcaacagccgacgccggcctccgaggccggaagtcagaaggcggaagtgaactgcagcctatcagcgccgccggcttccgcgcggcattgtggggcttgtagttcttgtgccgcagggctttaaaggaaacgcccacgtttcttccgaccagggatttccgacccgagaaccttacctcaaaggccgggaggcctttgagcacctccagctagggctgctgataaaaatgtagaaagcacagtaaaatttgaatttcagattcacaacaaatctagttataagtatgttcccaaatattgcacgggacatgctaatacggaaaaattactcgctagtctgaaattcaaatttaattgagcgacctgtgtgtctgcgtgtgtgtacacatgcatatatatatatttatatttatatgtaaatgtatgtttacatgtaaatatatgtttacctacaaatatatctttaataagtaatacggtgtctgtcgcacatatattatatcgtgtatgtaatgtataagtatttatttcgtttgcttggggttttgtttgcttttgctgagtccgacccctctacctgccgcctggcccttgcctcacgctccagtgccactgagatcaaggagagaacgaatttgccgctgactgggcagagcgagcgcgtggatcgcggccaccgcccgttcatcacccgcgcgcatctgggctggcaccgggcgaagaatcgtgcgggtctgggacctgggggcccagagggagcgagctcctgcgcgggcgctcggtccgcaggtttcgcaggctcaggggcgtgcctcgttctcacccccactccggaccccggtcctcttccctagacagcggccccctccacccctggctcccgcaggccgctagtagtccgcgccaggccccgccggcgcctctagggccccccagatcgcgcagaccctgacatccccgcctggccctgggttctgggagctgagagccggccagggtcctgctcgtacctccgggcgcccagcctcgggtctgctccccgcggacgccccaacctccccggccgaatggatggtggtgcgcgcgcgtcctactccggcggtgccggccttttctgttgccaaaactagacccaaacctctgcatgggattcgtctttgggtccccaccccgtgcgcccagcaaacagtgggtgagccatgaagatgtgcgagtcagccggaccctccccgtcaggcgcggacccgctgcggccagagaacccagtctgcgccagcccggctcgctcgcgaagccacgggcttcactgacgcgactttccaagacgtgggggtcaccatgggcagaggacatcggttcggagccagatcacgggccccataagcatcagaccataagcagcgccgccactgagagccgctcggaactcgcccagcatgtcgggtcccctagccagggcctggtgtacgtggtcgagggccctggaagccccgatggcctaggaggagcaggcgggcggggcggcgggtgtcgctggccggtagagagcttcggcctgacctagcgcaggtctggtgcgcgcagagaacaactccaagcgcaccgacgcccgcgagctccttccaaacaccgaacgggatccagagcccgagcccacaggcggcggccgggggagggagcagggtgctggccgccgcccgggagtgttcgcgtcctgggtgacccctggaaggacgtggggcccaaactccggctggggttgggagagcagcccccagaggctctccgcgggatcctctgccgggcgggaccgtggctccacaggagaagtgggtggcaagccctgcttggcggaaagcagccgttcccctcctcctgggcctggggcggcgcccctcacccctgttccccgcccctcacccctgttccccgccggccacatcccctgccccttggattccaagcgccccgcgcgccgaggagcccagcgctagtggcggcggccaggagagacccgggtgtcaggaaagatgggccgtctgggggacagcagggagtccgggggaaacgcaggcgtcgggcacagagtcggcaccggcgtccccagctctgccgaagatcgcggtcgggtctggcccgcgggaggggccctggcgccggacctgcttcggccctgcgtgggcggcctcgccgggctctgcaggagcgacgcgcgccaaaaggcggcgggaaggaggcggggcagagcgcgcccgggaccccgacttggacgcggccagctggagaggcggagcgccgggaggagaccttggccccgccgcgactcggtggcccgcgctgccttcccgcgcgccgggctaaaaaggcgctaacgcccgcggccgcctactccccgcggcgcctcccctccccgcgcccatataacccgcctaggggccgggcagcccgccctgcctccccgcccgcgcacccgcccggaggctcgcgcgcccgcgaaggggacgcagcgaaaccggggcccgcgccaggccagccgggacggacgccgatgcccggggctgcgacggctgcaggtaggaggcccagggccggggggcggttcggctccgcgggcgggggctggagcgcagcgctgggcaggcacctgggctcgcagctccgaagctgggaggtgaggggagagcgatcggggacgagctgggacaaggcgacacaggggctccctcggagttggatcggcccctgggacttggcgctcgcgagaggctggagcggccagagtctagcctgcgaggagacgcgggtcctgccctcagcgccggccgcctttggcgccaaagacagccccgcaggggttccgggagggccctcctcctgctgtcccctctccaccccgggctccgagggccgttgggagggtaaccccgggaagaggccggggtgcggggcgcgggtgcaggtggaaatcgccagcaagctcctccccgcccgcgcgctccctccgacctgcagggctgtgccaatcccgaggcctcagcttccctgaggagccagggccaggcccccctctggacagggagaaggatctgggcgggggccttgacccatggagttggttactaagcggtttcgatggtttcccgagggacagctccctgtggctctgagtttgtctgtcgagggctcctggcctgtctccggagcggtcccaggtagagaaagcccgtgaagaaatggcccgggccggcctggagggagacacctcacgcccccttagctcctgggccgcctcctcctgcagcccctgcctttcccggggcttggacttggggagcgatgattacctttgctcagcttgtattttggcctggacgctaggagataagcccatgtagtatgcacacgtctgctacataaacaggggacagatagacgatcttcaaccagcaagggtgcagggaaaagcaatgcaccccaaacttctgaccagaggtcatttgcttccaaagatgctgccatctgtttattcactgtctggacatttggaaatggctcaggctcattaacacaatgctttggtttttgttgttttgttttttgttgctgtcattgctgtttatttgttcagccttagctctgggggaggagtaaacaaagcgcgtggcctctggcacttactgagcgctgagccacccctctttggatttattcggggaaagattaaaaagcatttcattaagaacaggacacggtgtttgaaatgttgccatatatgaatgtatgcatt

SEQ ID NO: 16 - DNA, 4453 bp, Homo Sapiens
ttggctctgaagcctatagcatcgctgactcagtctgtcccctggaaggctggcagctcagcaagcacagaagtctctccagaagacagtgggtcacctgcctcccaaaagctgaaaggctaacttgtactttccccagcaggcagctggcaccctgagccctcggctggggcagagcaaaggagccttcctccttcctaccttcctggcactctccctgccttccttctgtcactctcaggtggacccagacccaaggtccagatttgcaaggcaggaaaatgctgcaggcctaggctgggaaagggcccaaagccgctagtggattgctgggactcagcctcctccttcccactaagagagcgagtcctactgggttcaaaatgaccccaagccctggttcctgacactaggggaaagagatgggggtgacagaatcacagaatccctgctatgttcctccaagtgtgcccagagatgcgtgtgtgtgtgtgtgtgtatacacaaatgtctgcttatcctcaggcaggaagggtggatgcagtcatttacacatggtctgtttttctggaggacaattttatttgataaacaattgtttctatctgaatagaataaacaaggctctatgatgaagtaaaacactaaatacacatgcattaaaaaatgcataattatctttttggaatgggctatacagagatgtgctttttaaaatgttaagagtgtaaaaggacaaacagtgaaaaataaatcttcctcttattttgtcctccagtctcccaattcctctactcagaggtgagaacagaacttccacaccctccagaacctccacagttagaactgtctacatgtttccattgtctttacttttattcttgcctgcacaaataaatgaattgctcattatggaaacttcccaaaagacccgttaacacttcaataggaagcaccaacagtttatgccctaggactttgttcccacaatcctgtaacatcatatcacgacacctaacccaatccttatcaagccctgtcaaaaacggactttaaaccaagctgcaaattttcagtaatctggccttgcctttccccctctgatagcaccatcaaacaaacccccttactgccgaaagcaataagcccggctttgttccatccactggttgtgttggtgatatctggggactgccactgaacagacgcacagagggagcccctacaggcaggggtttttctgtctgtgcttctgggagagtatgtctcgtacatttgtcgcgttgatgaagacttcacagctccatcagctgcgggcaagggggtctgaggcagtcttaggcaagttggggcccagcggggagaagttgcagaagaactgattagaggaccccaggaggcttcagagctgggcgaggtagagagtctcctgtgcgccttctctcctctctgcaattcggggactccttgcactggggcaggcccccggccaggtgcatgggaggaagcacggagaatttacaagcctctcgattcctcagtccagacgctgttgggtcccctccgctggagatcgcgcttcccccaaatctttgtgagcgttgcggaagcacgcggggtccgggtcgctgagcgctgcaagacaggggagggagccgggcgggagagggaggggcggcgccggggcgggccctgatatagagcaggcgccgcgggtcgcagcacagtgcggagaccgcagccccggagcccgggccagggtccacctgtccccgcagcgccggctcgcgccctcctgccgcagccaccggtgagtgccgcggtcctgagatccccgggccggatgcgcggcggccccagctcccgagcgtctgcctcccccgccctgggctgcccgggctccctgggctccccggcggctgcacggagtcaaggcgccccgtcccgggcgtcccccgcgggtgccgatccaggctgcccggagtccggagcccagagaggagagagacagctggggagcctggtcaccgcgggcatctcccctgcgctgcagtcgcccgcctggcctgccttcccgttcctccgcctcttgccctgacttctccttcctttgcagagccgccgtctagcgccccgacctcgccaccatgagagccctgctggcgcgcctgcttctctgcgtcctggtcgtgagcgactccaaagtgagtgcgctcttgctttgactgatgctgcccaaggacctctgatcagcaccaggggagaggaggggctgctcagggagctggggtcctccggattccatccacagcagggccagactctccccaggaaatgggacagggtggcagcggaggcttgagaaccacgggggttggcactggctggcaagggaggaagaggccgccgggactgccccagcctgcgggcatctggtagatgaagcttgcttgggtcaatccatttctcctggctggaaacccatggtcttccatttgagaactagatacgaacagggtgaggcgagagggagagggaagagtgggttttgggattggggccagtttaccctcaccctggagtccctggagcatgggacctttgatgaagcctcctcccgaatctcttccagggcagcaatgaacttcatcaagttccatgtgagtatccacccctacaacagttggctgcacagacaagttgggaaggcttcaggggacatcccctccctgccctctgctgcagggctgcgccaccccttaccacttccactccccctcgcttaccccacctttgttctctccagcgaactgtgactgtctaaatggaggaacatgtgtgtccaacaagtacttctccaacattcactggtgcaactgcccaaagaaattcggagggcagcactgtgaaataggtatggggatctccactgcaactgggagagaaatttggggacagggagggatgggtgggaggcaagagcaggcaggagttaggagctggaggtagggtgggtgacatcttcatccctatgtgacaagcataaacacacacacacgctcacgaaacagtggccacacaaatgtgaggtggggttggaaggagaccctgtccagtcttctggcaggtctgaaacgacatctttaaaatgtccgttggcagccgggcatggtggctcacgcttgtaatcccagcattttgagaggtcaaggtgagtggatcatttgaggtcaggagttcaagaccagcctggacaacatggtgtaaccctgcctctactaaaaatgcaaaaatcagcctggcatggtagtggatgcctgtagtcccagctacttgggaggctgaggcaggagaattgcttgaacctgggaggcagagatctcagtgagctgagatcacaccactgcactccaactgggcgacagagcaagactccatctcaaaaaaaaaaaataaaagttagttggaatgttcttctctttctcatattctctcatcctcctgtccccttgtagataagtcaaaaacctgctatgaggggaatggtcacttttaccgaggaaaggccagcactgacaccatgggccggccctgcctgccctggaactctgccactgtccttcagcaaacgtaccatgcccacagatctgatgctcttcagctgggcctggggaaacataattactgcaggtgaggtgggggcaacaaggaccaaaagccctccctacagcttcccagaaaccttgttaccatccccttctcccagagggctggccatagcacaagagaagtgcggcctctggttgagtcttccctgaggggaggaggcagggaaggccctctgggttggaatgacatcccctatctttctgtgttgccaggaacccagacaaccggaggcgaccctggtgctatgtgcaggtgggcctaaagctgcttgtccaagagtgcatggtgcatgactgcgcagatggtgagcatcactgacctgctgatgacagtggggtggaaggggacaaacttacatgtccccttattccatcacaggaggactgaggaggtggggggtgcccgagagggatgctttctcctacctgcctccctaagacatccctctgtttgtcctccaggaaaaaagccctcctctcctccagaagaattaaaatttcagtgtggccaaaagactctgaggccccgctttaagattattgggggagaattcaccaccatcgagaaccagccctggtttgcggccatctacaggaggcaccgggggggctctgtcacctacgtgtgtggaggcagcctcatcagcccttgctgggtgatcagcgccacacactgcttcatgtacggccctgggtttctcctcttcgactcttctgccccaccccaagcacatccctttctccttcccagcaaagtgttccgcctcatttctccctcatctgcc

SEQ ID NO: 17 - DNA, 6001 bp, Homo Sapiens
aaatttacaggtgttggtgtcacagaggaagagatcattttctctgtcatcataacctcaaattcaaagagaacactccagtcattaaaacatcttacagatttttaacaaaaaaaagcactactttgaagctttaaaatacttgtcctaaattttaaatccaacaactatagctgtactgcaaggtcactgtctactgataacctcaaaatctagttaagtgatcaatattcgtttccattttccacaattcttttctagtcaattctcctttagtatccttttctgatagtgctattttttaaagcttgcgttaatactgacagtggtgaatgaaagcttaacatttgcttcctgttttttttttatttttattttttgctcattaggtggacaatatttatgaccacaaaactccacattttggaaaagagctagtgatgatctctgaatacccttttaccatttccccatctttaattgttcttttgcttcaacgactgaaacaaccccttatttgaaatgtatccagacaaagaggaaacaaagcctcaataataaagataaacaggcacagtgttttctgtgatggtctgtttggctcaaatgaagattgatcacctctaagttaacaggggtggaagcggggtgccaagttcttgacaacctatctgcaaaaccagtttattctctttagtttatgcagtcccctttaaaatatctggtaaatatgtaatttcttgattgcaaatgtcaacttcacatttaagttagttatttcctaaaacaatgcaagggctaggaatgaagcaaaccagtctgtgttggactacaaagccatcaacatttccaaaaattgtttttgcaggctcataattattaccataataaagcatctaaaaagtgattaggcaatagcaaagtgaaacttattctttcaaaaacaacacacatgtacgcatgaatcaagaagttatagaaacatgttgagttttattaaaatgccaaatttagaaactgccaaaaaagagaacaatctattgacccaaatctaatagggttgcatatctcaacttgtctttgtaaaggataaattagaatgatgcataataattttccttttggcatttacatcagtaataactaggaactatacaggctttcaccctgagttacagttggtcattccctcctctctaaagttacatacacttcagcttatatacatctttgaaagacactttattcagagccagatttaactacagcaaaattatattcacagaagatgaaaaattacatacacacttgctaaaactagaacagaccacacctaggggacaatacccaggcatgttaacggagtttaaaatgccaaggaaattacaccacaattctgcccagtatactacaggctgtcaaaccgaaatgctatgccagctaggagtgcagcaactcccatcctctggccctatttaattaggaagcttcagcagagcgaagcctgccaagcgttcgccgtcagaatctgaaggaacccgagcgagcaagaagagtgcctgacccactccacagaagcctgtccagaaatggaggagtcagcgcccactgaagtcggttccgccctcggctcgcctacatggagcctgaccagcctcagtcatgcccactccggcctgggagacccgcaaagtgttctttttctcaactcccctgtactaccttgaagcttagggaagcaaagagaggggcatatctggactgcaaaaccaatgtcttttgccgcctaggagagaagggaatgagagagagagagagatagatagatagagagagagagagagagagagagagagagagagagagagagagagaaattctattgaaacccagctcctctagaatctgtgtgacctggtcttcaacgggagaccagtgcgacctcatggcacctttgccaggaatcagcgattcccctgcagtcaccatttgatttattgctttctcgctcattctttctcataaagttatttcttcctcatcctagtaagacttttttctttaatgatgacaaagcttctgtttcagtgtttcccctaggattggtgctctttcaaaacagtgaacccagaaaaccatcccgtttaatatttctcaaaatcctcgcagctccaatgtaagcgcaagcatgcaaaggtttcctgctacacctgcactttctgcccatcccagaaccacccctcacccccgggcctgcaacagttccccttgtttctctggatagaggtgggtggtattaggggtctagggcagtaggaggtgaggggctgaggaggcgcgctagggtaggctggtctgtgctggatacgcgtgttcttctgcggagttaaagggtcggggacgggggttctggacttaccagagcaattccagccggtgggcgtttggcagtcacttaaggaggtagggaaagcagcgagcttcaccgggcgggctacgatgagtagcatgacgggcagcagcagcagccagcaaaagccctcgcaaagtgtccagctgctgcactgccgcggggactcccacagcaccatgactagttcgtgcaactctgcagcagcaaacggcttccgaggaacacaggatcgcgggggccgggcagcgggctactgagcatcccgcggacggcggcagcagaggcggcggcggtggcagtggcacccggcggggaagcagcagccaaacccgcgcatgatctcgagagtttcagcaacatccagggactgggctcagccccggagcgagagggtcgtccgctgagaagctgcgccggagacgcgggaagctgctgccataaggagggagctctgggaagccggaggacaggaggagacgggagtccaggggcagacgagtggagcccgaggaggcagggtggagggagagtcaaggcgccccgcagcccggcagccgcctctcgagctctgccgcccgcatccctctggcgtttgggaagcagcaggtcctcagcccgcccggggtcacgtgggaagaggcagtcgggctctgattggtggagcaggatgcaggtcccgggagggaggggtcgacgaggaggtgcaaggatgcaaggaggaggcggccgcggaagccacagatgggctcgctcgccaggcgctggcccgagtggggctaggcggggatggctcaaatgagaagctcgggcttcagggtgggctacccgcacactcatataccattcgcctcactctccgctccaggacgccccctaccgaaggcggggtccggactagcgcccctcttccgcgcgtgaccccgggccgcgagtgcgggccgcggctgggtggcgtctctccgagctggagatggtgggggcggaggtgtcagaggagcagcagcagcagggcagagaggggcgagtcggcgcgggagagggcgtcctgctggcgaccggcgctccagcgtgcgggagcgcgccgcctaggctgtagggggatgcaggctgggaatgtcgcggcggagaggccagggacgtttctctagggatttacaggaaagagggtgagaggcgatggtgttagaaccgctcttgccgacctggaagcaacagcagcatctcccacaagagcgtgcaaccccaaggctgctcgccgaggcagctcagccatcccggcaggcgctctccttccttctctcttctcccctctctcctcccaggccccccgcagctccgacccagcccaagcgttcgcaggtttgaatccctctcctcatcacccgctcctctccagcccgtagcctattagtgtgtccacctgggaggtgcggtcagatgtgtttggaaggtcagattggtcgggacaagtggtctgagagaaagagaaaggctcctctgcatacgccgcgggtgggttgccgggagcatcggccgggcagcggcgtccgggaaggggagagcgggctccatttgttggcccaggcagtgaccctgcgttccttactcgggtctttgccggatggccggtgacctggggcgacgagagaaggtctaactcggcaggagtctctggctctgcgcgtttctttcattctctccagcgggaagggcaaacggcatagcgggacccgccttccgtctgctgcattcttcaggcagttagacacactctttagcctaatggaattttagtcgccagtaacgggaccaagagctttcggggacaagggtggagaggaacatctttcttccatgaccggggtcactattgcagtctcagtgttttggatgccccatagggaagagctttctttttggtgtgtgattattcagtgattcctgtttttgtttttgtttatcttctctccgctctccttctctattcctctctgttatccctcctccttcttctccccccgctttcaaaagcctccggatcctccctttttctatttaaattctccttttgtgcccctctttctgtgtcccctgaatttaggagagcatttgataacatttaacaggcaattagtgtccattcccaatcacttaaaagaggcattcatatactttgaaaacgggactatctatcctttgcagacaccagcagaaaaacaaattgtacccgagtaatccttttaagtactttaacctccaacctcctcccacttccttgctttttaacttctcctttgagagatgtgatcgtgcagcacctcagtgcctcaacgaaatctttttttttttcctgtgtgaaatccatccctttatcttacatctccgcctccgtccgagactgtccctctcccctcccacctccaaagatttctgaatctcagtgtctctcactcctggcaattaagcagcagatcccagcattctagtcggtggcatctcgctcctcaccgacgaagactccattaaaacagatcaattagaccagacgttggaggcatcagaaaatcggcttctagacagagcagctaaattctttaaggaaacagaatacccattagatagagctgccaactaatattgcaaaacaaggaattagaaatttctttcgctacaggctttcagcagagaaggcaacataaatatagatcaagatttaacaactctacagcagagaatgagaacatgtcattttccatagcaaggctggtgtggtaactaatcaggcttatgaaaataagtcatgcttgaaactaaaggcaaagtccttaaaagtgtttatgcagtaattatgataatgaaacaggacctgctaggatttcagagtttggctatgtaagtagaattttagagaacctcttagcagaggaaaactgtttttgaattttctgctaagtaaatttttggcatactttctaataatatatgctcttcctaagacgttttgccaaaagtaagttaaaactccaaaggagttaattactggttgtaactggttaacaaatgcggttgcttccacagaggtcctttaaattattaaacagtttgaagcaaagccttttcaatgggaatgctgcaattttgttgcacttactctgtacttagtgttatagtgccaccaagaaacaaattctgaaactggcaagcaccaccaagtggcagaagaacatcactcattgagcagagaattgtattactgaatatgtaaataaaaatatatacattatttagacttgtcactaggtaccaaagaagtagacaagactgcattagcaattggattagtgctttaacttttccccagcaaggcaaaatcagtttacttattagaattaaatttaagtctatgaactgtactttgcattgcgtatcatatgattgctagtaatatgacacaatcataccatgtatttgcaaaattcttattttaaaatactataccatatttactttcaatcttcttgagctagaacactttatttgtggcatatacactctagaattgatgcagaggagcagagtccagttgtt

SEQ ID NO: 18 - DNA, 7001 bp, Homo Sapiens
aatgcaatggaaaaagagagattgtaaagctagaaggcttaggaattgcctcttgattaggtgtggaaggcaagggaaaatcagccctcgaagaagacagtgagattttaatctgggtggctggagagacagtgatgctgggcacagacacggggaagttgagaggaacaccatgtttgagaatggtgactcatatttgaacaagcctgcaatgcccagcagaccgctggaaaagtggggctggagacacattcaacggaggagccagatcaatctttacccttcttcacctgagagagccagtaagtcacggctggaacgtgtgtgtccagcaggagagggtagggagggaagccaagagagctgggagcccgagtgaagtttttgccaaaggcagaagaggaaagtcggcgtagcacagtatactttcccacccatgctcaccaagcccagggacaaggctcaccaagatgagtttggaagagaatgctggagagaaagtggttaagaaaactgcctttactgaacttcttgggctaactttgattgtaagtctctgaacaatcaaagcctgtgaggagacagctaaccttcttattcttcctatgtcaatagtgaacaattgcagatcccctttcctttccttctcctttcccctgttcctctctcctccctccctgaatactcttgcttttttctgggactggtctagagcatgggtggccattgttgacctacaggaggcaccactgtcaccaacaaagggtaacagtctttcttttcaatatttatttatatccagtatttattttcaatactgactatggagagagctctcctgtgctcaaacactgcaatactgggggtctttcaaagcacaaaaacatatatttgcatgatggcatcattaacatttttatggctttctatttcttttttgtactggtctcaagagccactcataaatctctcagtaactgcatagtgtcccagggccagagaccggccactcctggcattgtgattagagtcatttaatatccaaggtggtgactaatgtctggcaacaaagcctccattgggtgtcatgtgtcctgggaccctgagcgtgggcactctaggagcacctcagtattgcgtgttagtactatggccgagagaatagttgagaaagtggtcaagaggtggatccatgtgaacgccactgggaaatgagagacctcgttcccaatcacggtcagtgcaactcgaaagcctaaaatcagtttaaaacaaaggtatctacctttatcttatgttcatatcctaggcttttaataatacgtatttttcacatgtttacagaaagcagtcaactgagctattcatggaaaggtttgtgggtttggttaacgaagtggaggagtattacatttcagctggaaacacatccctagaatgccaaaacatttattccaaagtctggtttcctggtgcaatcggaggcatggcaatgcctctgttcagagactgggggctagggccagtaaggcatttgatccacatgtatcccagaaggcttttattgttaaattatattctttcggaaaaaccacccatgtcctattttgtaaacttgatatccatacacttttgactggcattctattttagccgtaagactatgattcacagcaagcctgtttttcctcttgcttggggtggcagcagaaagcatagggtactttccagcctccaagggtaggggcaaaggggctggggtttctcctccccagtacagctttctctggctgtgccacactgctccctgtgagcagacagcaagtctcccctcactccccactgccattcatccagcgctgtgcagtagcccagctgcgtgtctgccgggaggggctgccaagtgccctgcctactggctgcttcccgaatccctgccattccacgcacaaacacatccacacactctctctgcctagttcacacactgagccactcgcacatgcgagcacattccttccttccttctcactctctcggcccttgacttctacaagcccatggaacatttctggaaagacgttcttgatccagcagggtaggcttgttttgatttctctctctgtagctttagcattttgagaaagcaacttacctttctggctagtgtctgtatcctagcagggagatgaggattgctgttctccatgggggtatgtgtgtgtctcctttttctttcaggacttgtaggattctttgtgccatttgcatataatttggcaggttcacattttttaagagccctatgaagtgctttttgcatgtgttttaaaaaggcatttgaaaattgaaagtgtgatttatggaaattaaatcatctgtaaaaaattgctttggaaagtaatgattgctggccataaagggaaatatctgcgatgcacctaatgtgtttttaaccctttatttgctgacaatctatagtcattaatgctaaactcgattttggcttcagctacatttgcatattgtccaacaatggtctatttttgtaagaattagataaaatgtatacttgatataaaatagtcaaaaatgtaactcttagtaacagtaagcttggcatttagatagaccatgaacacttcgtcagatactctgttgggtgtttgggatagcaattaaaacaaagtattgatagttgtatcagagtctattaggctgcagcaaaggaagtttattcaaaagtataaactatccaagattatagacgcatgatatacttcacctattttttgtctccttaatatgtatatatatatatatatatatatatatacacatatatgtgtgtgtgtatgtgcgtgtgcatgtttaacttttaattcagttaaaaacttttttctatttgtttttcatctggatatttgattctgcatatcctagcccaagtgaaccgagaagatcgagttgtaggactaaaggatagacatgcagaaatgcattttaaaaatctgttagctggaccagaccgacaatgtaacataattgccaaagctttggttcgtgacctgaggttatgtttggtatgaaaaggtcacattttatattcagttttctgaagttttggttgcataaccaacctgtggaaggcatgaacacccatgtgcgccctaaccaaaggtttttctgaatcatccttcacatgagaattcctaatgggaccaagtacagtactgtggtccaacataaacacacaagtcaggctgagagaatctcagaaggttgtggaagggtctatctactttgggagcattttgcagaggaagaaactgaggtcctggcaggttgcattctcctgatggcaaaatgcagctcttcctatatgtataccctgaatctccgcccccttcccctcagatgccccctgtcagttcccccagctgctaaatatagctgtctgtggctggctgcgtatgcaaccgcacaccccattctatctgccctatctcggttacagtgtagtcctccccagggtcatcctatgtacacactacgtatttctagccaacgaggagggggaatcaaacagaaagagagacaaacagagatatatcggagtctggcacggggcacataaggcagcacattagagaaagccggcccctggatccgtctttcgcgtttattttaagcccagtcttccctgggccacctttagcagatcctcgtgcgcccccgccccctggccgtgaaactcagcctctatccagcagcgacgacaagtaaagtaaagttcagggaagctgctctttgggatcgctccaaatcgagttgtgcctggagtgatgtttaagccaatgtcagggcaaggcaacagtccctggccgtcctccagcacctttgtaatgcatatgagctcgggagaccagtacttaaagttggaggcccgggagcccaggagctggcggagggcgttcgtcctgggactgcacttgctcccgtcgggtcgcccggcttcaccggacccgcaggctcccggggcagggccggggccagagctcgcgtgtcggcgggacatgcgctgcgtcgcctctaacctcgggctgtgctctttttccaggtggcccgccggtttctgagccttctgccctgcggggacacggtctgcaccctgcccgcggccacggaccatgaccatgaccctccacaccaaagcatctgggatggccctactgcatcagatccaagggaacgagctggagcccctgaaccgtccgcagctcaagatccccctggagcggcccctgggcgaggtgtacctggacagcagcaagcccgccgtgtacaactaccccgagggcgccgcctacgagttcaacgccgcggccgccgccaacgcgcaggtctacggtcagaccggcctcccctacggccccgggtctgaggctgcggcgttcggctccaacggcctggggggtttccccccactcaacagcgtgtctccgagcccgctgatgctactgcacccgccgccgcagctgtcgcctttcctgcagccccacggccagcaggtgccctactacctggagaacgagcccagcggctacacggtgcgcgaggccggcccgccggcattctacaggtacccgcgcccgcgccgcccgtcggggtggccgccgcgcccggcaggagggagggagggagggagggagaagggagagcctagggagctgcgggagccgcgggacgcgcgacccgagggtgcgcgcagggagcccggggcgcgcggcccagcccgggggttctgcgtgcagcccgcgctgcgttcagagtcaagttctctcgccgggcagctgaaaaaaacgtactctccacccacttaccgtccgtgcgagaggcagacccgaaagcccgggcttcctaacaaaacacacgttggaaaaccagacaaagcagcagttatttgtgggggaaaacacctccaggcaaataaacacggggcgctttgagtcacttgggaaggtctcgctcttggcatttaaagttgggggtgtttggagttagcagagctcagcagagttttatttatccttttaatgtttttgtttaatgtgctccccaaatttcctttcatctagactatttgattggaaatatgtcagctatgatgatgactttctgggaagcgattcctgtcacccgctttcccctcctccccaccccacgtcctggggctttagagagcgattgggagttgaatgggtctgatttcggagttagctggctgagtccgcgctggagcggattgctggcatgtgacttctgacagccggaaatttgtaggtgtcccgcgagtttaaaacaagccatatggaagcacaagtgcttaaaaataatctcctgccagcccagtgacaagcctgtcccacccggggagaatgccccggagtggcgtgcgggtcagccagggtctgcgcctcgcagccactgtggaaggagcgcggccggtccaggacacaggagaccactttgtgacttcaatggcgaaggttgtgtgtcctcattttaatttttttccctacaagaattgttctttctccctctcctctccctcccattttctcttgcccagtttctccttttgttttttgttttttgttttcctgatgggcctgcagagggattaggtgggcgcttctggtgaacaccttcctaggtggccacaggacaggtgtaccccggactgggtttggaagcttcagggcgccacatggctgggtcctgaattaggcatttcccaactgtacactggtatccggactggtgtccctatatctttctgccttgtaagccgtggaccagtttttgttcagtattctgtttccagggatatttatagcagaaggaaggggactaaagtgcagtttggccccagaggatactgaagggcagattctgggggtattcagtgtgcatcttcagccgccttggagaaatttagagcatcccacagccacgcagatccaagctgtctttactcaaaagacaaacaatgaacaaaacttttaaaggttggcatatttcaaattaattttacttgttttaatttagggttaaaacagagaaaaaggatttcttctgcccacctttttttttttaaatggaagaacaaagtacagcgattaagtctaattccacacaacatttaaaactgcttgatgtgaaggaaggcactggtatgatgtgaattccataaccttatgatggactccagaaaccattttcttccctatttaattttcagttcttttattgcaaattaatgctgctgaatttcaatgggcactaatgagactgctccttggtagattatttactgccttgctaataattacaaagtgaacctggtcaaatacagaggggatcgcatcttattcaaaattgttcatcatcccagtgataagtggtatcagtgtaatatgccctatcttacactttctgcattacatgatattcaaacactcttagaataataaaaaaagagacaaggaacttaaaaattaaaaaaaaaacttgcacaaatgggactctgtgtggaaattcagttttagaatgatttttcctgtgttttatttcccggattatctttcctcttttgttagaattctgcctgttattatccagcaaggaaaagaagcatctatgcaagttcttcatatggacagatattatttagtatttttcccctctcagtttttctgcttaaatgactctgggtataaaggaaaggattgattgggctcttttaggaaactttaagtttcttaagtagttctcaaaagttttggggctgaaagcagtgttttcaaactgcttgtcatgacccagagggtcatgaactcagtttagtgagtctagaatattttttaaaaggactaaaatggaaaggaatataatagaaaatatcagagtgcatggtatttcgtaaggataagttttgt

SEQ ID NO: 19 - DNA, 3501 bp, Homo Sapiens
caactctgaaaaccatctgtagacattctgcaggctccatctcaggaacaatggctattttttcgggtagttgaagcaaaattaagtccaatgataagcaaatataaccattatcaaaatcttccatttatgtttgttaaagcaacctaagtatgatctgagaaggactctgtattctatatttgagtccttgtggatgaactgtaacctagcttaataggcagacaagattgaaaacctaatttaggagtatgtgcctttaacaatagctgagtcttggccaatcccagtggccatacttcaaccattcatacactgctgagtgttcaaactgtgttcaaagaaggcaaaagccaacctgtaaccaatccagttgtttctctgccttacctccaatttctgtatgtcacttccctttttttgtctataaatatgttctgaccatgaggcatccctggagtctctgaatccgctgtgattctggaagctgccccattcgcaaatcattcattactcaattaaactgctttaaatttaattctgctgaagttttcttttaacaggtttagaaaaaataatggcaaaaatgaatgaaaatccaataaccctggaagcagaaaaggctgggggctccaataagtgtaaatagtcccatccctatattttctccatggcaattacaatccagcacattatatatatatttttttgcttctcgcattttggcttagggtaaagctttttaaaacaggcactgccaaccagtgttatcaagaaggtctggatgccgttttgtgggaacattttaaagaggaatgtccaaaaggaaaagggggatgggttgggagaagggtatcaggcgggtatctcaaaaccattcttagggctataggtttaatttatttggttgtggacgtcagagccgtcatggtaagaaggaagcaaagccttttgtaataattaaagccttcagaagcagcgtgccccattgcccactagtgcgccgtgaagtctggtgttcacctacagggtccctctcagcactgcccaggcctcccgagtgctccagcacagtagcttggagcttgttggtttggtgaccaagatacactccagggaatatgccatgcagtggagtctcttccccggcactgcatagcaaaaggaaagggccgctgggtgtctgtgggtcctgggcagtcacagaagccaccgcgctggcggggaggagggggaccgatgcggtccatgtcccgggcagccccaccttctctgcctgcgaagggcccttgtccggcgggaggagagaggcgcgccccacccgggctcctctacacctgccgccgcctgggccgattccgcgggcctcgcccggcgcttcagccgattcccgcccagctccgggctcatgggcgcggtcagcagggcgggccagggcggcggggcgcgacactgggaggaagtgcgggccgcctgcccgggcgcgttaaggaagttgcccaaaatgaggaagagccgcgggcccggcggctgaggccaccccggcggcggctggagagcgaggaggagcgggtggccccgcgctgcgcccgccctcgcctcacctggcgcaggtaggtgtggccgcgtcccctacccggccgggactttctggtaaggagaggaggttacggggaacgacgcgctgctttcatgccctttcttgttctaccttcatcggccgaggtaaaagtgctgaaaccatgtgaataaaatacaggtgggttccgccagcttcgctcctgaacctacccgcgctcgggatccagaagctgcgccgggagagaggggctcaggcctgggcggaggggacggaggtcagaccgtgcggaaagtgacccgggcaccccagggcgcccaggcccccagggagcgcggaaagtgcggtcgcggcccggccctcgggagacgcgggattgggatcaggcacagcgcgaggaagtcgatcttggagctagaacattttcctttggccatttacacgaatccactggaaaatgccgcagtgtttatcaaagttactcaaagtagaaatgtccagacgtcttatgagcttagacaaatcttttactacaaaaagaaacagcagttgcattcaaacaacaacccttctgaaccactactaaaatttagcataattactcttgtggatacattttcattgtcaagtaatttacttagccaatgaacttggagagcaagaaagttttatgtagtaaaatgtaaatttgagttaagagttaagggtgtttctttttgtctgtttgtctgtttttggcaatgtggctccaaaaccttaagcccacctaaaaactatataaatgcaatccattcttttgttggaatgttcaaggactagaaagacaattggagaagtgagagtttgaatctttttttacgttggaaacagtgttgcaaaatattttttgagttttgcctgacttagcaaagattcagtcgaactcaagtagagttcaaagcattgcagcgtgtagtaaaaaaaaaaaagagttgaagatgttgtgccatatctgattcttggtattaaaaataaaaaaaggaaccatttaatccctaagagttcctggaagaaatggaattgattctaccatctgacttctttgtcttagtagggacaaattcattgccttcacacaggcagcattttaattaaatgcaactaaatacattgatgtcctccttctccccagtgaaagtccgagcagtgcatagatagaattatattttctcaaaaaggcttaaatacatgtaaattattaagtgttttaagtgagaaatctttgtcagttgaaattattttatcaaatcatttttgttctgaacggcacttttgttttaacgtatttagaaaactcttgcattaaaacagaaattgatttgtattatcccctgtatttgaagtgcactttaaagtgtatttgaatgagagattataatcaaattacttgatttgtgtcttatcctcttactcttctaccttggatttgaaaaggttggatttgaacactaggaaaaaagagatttttctactgagggattgtgggaagatttttttttaagcctctgtatttgaagtgaaatataaaataggattttataatagtcttaataactagaaagttttaagctaggataaaaatggggtgtatactttaggtctttatctttcctgagagatgaaattggtagaaacgttattttattgctagatttcactttagaaatgaatcaccctgatctttgttaggcccctatttaatattctaaatgcaggtctaatctctctgcttttttttaatggaagacttcttagtagaacttcacttatttagcacattgtttgcccatggttataatccaatatgcttgtgccaagacgtattttggaattcaagctttttcagaatttggaattaaaatttagaatctaaatttcagaac

SEQ ID NO: 20 - DNA, 4216 bp, Homo Sapiens
aggtaacaataattatgatgtaccaggctccgggccaaagtcatcacctgcattaggtcaccaaatcctcaggccaacccattacagtcatgagtcacttaataacagacacattcaacaaattccttgttaggcaatttcatcattgtgggaacatctcagagtggacttacacaaacctagatggtctagcctactacacacctaagccatatggtctagcctactgctcctaggctacaaacctctacagcatatgactgcaccaaatattgaaggcagctgcaacatgagggtaagtattagtgtttctaaagatagaagatggccaggcgcggtggctcacgcctgtaatcctagcactttgggaggcccaggcgggtggattacttgaggtcaggagttcaagaccagcctggcgaacatggtgaaaccccatctgtactaaaaatacaaaaattagccagtgtcgcggcacttgcctgtagtcccagctactcaggaggctgaggcagaagaatcacttgaacctgggaggtagaggttggagtgagcctagatcaggccactgcactccagcctgggcgacagagggagactccatctcaaaataaataaataaataaataaataaaacatagaagatgtacagtaaaaacacggtaattgtttttgtttgtttgttttgagacagggtcttgttctgtcatgcggactggagtgcagtggcaccatcaggctcactgcagcctcgacctccttggctcaagtgctcctcccacctcagcctcctgagtatctgggactacaggtccacgccaccatgcctggctaatttgttctgaattttagtagagatggggtctcactgtgttgcccaggcttgttccagccttctggcttcaagtaatcctcccacatcagcctcccaaagtgctaagattacagatgtcagccactgcacccagccagtaatataattttatgggaccaccttcatatttgctgtcccttgctgacttacacatctttatgcaatgcatgactgttaccatcattatcatctctattttccagatggggaaactgaggcacaaagaatctaacttgcacaagttcatctgcttagtgatggaacaaagatgtgaattcaggcagtctggcttcaaagtccacacgcctaacaaccacaccagattactagattgcttttttcttttttctttttttttttttgagatggagtctcactctgtcacccaggctggagtacagtggtgagatctcggctcactgcaacctctgccttctgggttcaagcaattctcctgcctcagcctccccagcagctgcgattacaggcgcccgccaccacacccagctaatttttgtatttttagtagagatggggtttcaccatgttggccaggctggtctcaaactcctgacctctggtgatcctcccacctcggtctcccaaagtgctgggattacaggcgtgagccaccacgcccagcccagactgctttatttttgtatttgtatttattcatttacttattttgagacagggttttgctctgtagcccaggctgaagtgcagtggtgcaatccagctcaccacagcctctactcaccggggttcaaaggatcctcctgcttcagcctctggagtagctggggccacaggcatgcaccaccatgcccagctaatttttaaatattttttggtagaagtagggtctcactatgttgcccagactggtctcaaactcctagcctcaagggacccttctgccttggcctcccaaagtgctgagattacaggcatgagccatgcacccagcccctttttaaaatttttttgagagacaagactttgatctgttgcctaggctggagtgcagtggtgagatcatagctcactgcagcctcaactcctgggctcaagcaccagactccttttatcacattctatctcacacgcgtgtggttccaatcctgcctctgccacttctcagttgtatgccccaacccaacctgtctggctctgtcctccttaacagaaggacggccctggccacgggccacagccagcaacgcttaagcaccagggccggcgagtgccctgccgtggcacggctccagcgtcgcgctctcgaattcatttgctttccttaacgagagaaggttccagatgagggctgaaccctcttcgccccgcccacggcccctgaacgctgggggaggagtgcatggggaggggcggccctcaaacgggtcattgccattaatagagacctcaaacaccgcctgctaaaaatacccgactggaggagcataaaagcgcagccgagcccagcgccccgcacttttctgagcagacgtccagagcagagtcagccagcatgaccgagcgccgcgtccccttctcgctcctgcggggccccagctgggaccccttccgcgactggtacccgcatagccgcctcttcgaccaggccttcgggctgccccggctgccggaggagtggtcgcagtggttaggcggcagcagctggccaggctacgtgcgccccctgccccccgccgccatcgagagccccgcagtggccgcgcccgcctacagccgcgcgctcagccggcaactcagcagcggggtctcggagatccggcacactgcggaccgctggcgcgtgtccctggatgtcaaccacttcgccccggacgagctgacggtcaagaccaaggatggcgtggtggagatcaccggtgagcccccctgctcctgcaggggagaggaggaggctagcagggcgggcagggccgggggcgtgcggttgaaacgggggtcccgggggcctggggagttaaacgttggcccagcaccgggaaaaacaggactcctgattcccttgctcaggaattgggagtgcgggtcgcttctaagggcgctttctgctctgtaatcccagcgctttgggaggccgagacgggaggatcgcttgaggccaggagttcaagactagcctgggcaacatagcgagacgcgcccccccgccccgaccccgcgccattacaaaaaaaaagcaaacaaaaatttttttaaagatcatcgatgaagagagaaaatgcgcttttctacagagtccccttcccacccacagccccatccccagataagcggggagttccctggcgcggtgccagtttctagccgctgagtgggcgtgtgcgcggctccaagtgcgcctgcgtactgctcactccccagctccgcgccctgctccgttcctcccaaaactctgaatcgaagaactttccggaagtttctgagagcccagaccggcgggcacgcccccatccccaaccccctctgttaatccctaccagcctgcagtcctggctgcttccaagcaggaggtggggcctctggcctagcggggccgaaaggcagtcccctcccccgcagtctgatttccctcttccccccaaaggcaagcacgaggagcggcaggacgagcatggctacatctcccggtgcttcacgcggaaatacacgtgagtcctggcgccaggtcggggtgggtgggtggcgtgggggtggggtcagggaagagggcacagggacccacccggtgtgtaatgtaacgcttgcctttcctctctgcacgtccaggctgccccccggtgtggaccccacccaagtttcctcctccctgtcccctgagggcacactgaccgtggaggcccccatgcccaagctagccacgcagtccaacgagatcaccatcccagtcaccttcgagtcgcgggcccagcttgggggcccagaagctgcaaaatccgatgagactgccgccaagtaaagccttagcccggatgcccacccctgctgccgccactggctgtgcctcccccgccacctgtgtgttcttttgatacatttatcttctgtttttctcaaataaagttcaaagcaaccacctgtcactggcccaggccctggtgtttgtggaaggaagcctcaggcacctgccatttgctggctttcaggagtcatctttgctcaggcccgtgctgggccatgtgggtacactggtgtaggttgctggacacaggctgactcacatccataaagacagaggtcttagggccgggcgcagtggctcatacctacaatcccagcactttggggggttgaagcaggaggagt

SEQ ID NO: 21 - DNA, 11001 bp, Homo Sapiens
ccaagtcagatgttccccaattacctgtggacaggtcaggcatattctgagtctaatttcactccacaggcctaataccttggagccagaaagcttccaggtaaaaagtctgaagggggcctcctcatgtcattagatggactcctgcatctccagaagattttccacaccaggaaagatcaaagcaccaaggcaattcttcctggcttcttgggacaaccctaggctttggcatgagtggtctggaagcctttgctttagttacaatgcctatacactcctggaactgttttgcagggcttgtcttccagcacaattcctcctccaagccttactgtagctacagcccatcagtcctgtctagtgacaaccaagaaactaagaactatgtactcacgttcacctccccagagtcattttccttcaggacaaagctcagggccttgtcactgggccctgccaggagccgcagccgcaggggctgctcatcatccaacagcttccgcaagtacactgtgaaggggaagtaatgatcagagacagggccagctgctcagcccctgcatgctcaggtgcatgcgtatataccctcacatagggcagggtggggtgggaagcccaccttggccgtgacgctcagcgcgctcaaagagtgcaaacttgcgggggtcatccaccaccaagaactttcgcagcagggcctcaatgacttcacgtgcccttgtgcgtgacagcacatgcaggtgcttgacagcatccttgggcaggtaaaaggaagtgcggcgcctgacacttgtgccccgtcctgggccccgccgggcatcctgcaaggagggtggcttcttgctggagggcacagagacagggcgcaccagcttcagctgaaccttgatgaagcctgtgtaagaaccgtccttgttctaaagaaatagagaaaccaaaccttgataataggttccaggtgagatgtcagtctacttggggctaggctgggtatgcacaaattactgcttgcgcccacccaagataacctcagttgtgaccctctgagtatcaggcacatagctgggtacctgctcctccccacgcccccttcctgagcagtcaactcaccaagctcatgaagaggttgctgttgatctgggcattgtactccttgatcttctgctcaatctcagcttgagaaaggtcaggtgtctcccactccacaggctcgtcctgcaagatgggccagcatggacacagggcccttgaggaacccagggcttctctgaaaaatggcctctggggcagtctttggaaactgactgcctttggccccctgtccctgatgtacatatacatagctggtgcccaccctgaacccaccactgctcctggttttgcatgctctgggtggataagggaaagacagaatcatttggcttctctctgctgcctgcctagggcctcagcactgaatgtagccttaaggataccacagaagcaggggcaactgaaggcacatggccaggggccaggaacagctgagggactctgaagagggactctcatttaaagtaaaatcaggctgggtgtggtggctcacatctgcaatcccagcattttgggaggctaaggtaggaggatcacttgatcctcaggagtttgagaccagcttgggcaacatagcaagacctcatctctactaaaaaaagaaaaaaaaaaattagccaggtgtggtggtgtgcctgtagtcccaactgttcaggaggctgaggtgggaggatcgtttgagcccgggagattgcagctacagtaagctattatcgtgtcactgcactccagcctggggaactgagtgagaccctgcttcaaaacacaaaaaacaaaaacaggctgggcacgttggctcacgcctgtaattctagcactttgggaggccgaggcgggtggatcacctgaggtcaggagtttgagaccagcctgaccaacatggagaaaccccgtctctactaaaaatacaaaattagccaggcgtggtggcacatgcctgtaatcccagctacttaggaggctgaggcaggagaattgctcaaactcgggaggtggaggttgcagtgaactgagatcgtgccatcgcactccagcctgggcaacaagagcgaaactcggtctcaaaaaaaaaaaaaatcagtaaaatcacacctcaattgcacattctgatcacagcaccctagttgagttggagtgagggtttgtcctggagaaggcagcccatttttctcctctgccccggcacggggccatgacccactgcagggtgagaggagtggagagtggtgcacatcagtagtccagccaccagtggacagagtagtacttggagccagttctccatgtctcacacatagtgagaaaaatcactgtgacatgatgtttaaccttgacccaagctgcataaaaggcagctttaggccaggctccaatctgccagaggtacacaggcagcttcctggtgggtttctgcacctgcctgtgctgtctggagatttggcccaaagattttttttttttttgagacgaagcctcactctgtcgcccaggctgtagtgcagtggctggatcttggctcactgcaagttctgcctcctgggttcaagcgattctcctgcctcagactcccgagtagctgggactacaggcgcgtgccacaacaacacccggctaatttttgtatttttagtagagatgggatttcaccacattggccaggttggtcttgaactcctgacctcaagtgatccgcctgccttcacctcccaaagtgctgggattacaggcgtgaaccatcgtacccgacccagagatttttaactcgaccactcactccccacctcatctagggactggattcttgccggaagggtggagtgtgggacagggcagccagggctctgaaccgactttcttctcccagactcccttggccccactgcatcagccttacttcctgttgacgtcagataggccctagttagaatgcgagtgtcacagacacagctaagctcagcgctgaccaatactttgtcccagaagaattcccacaaggtttcctgtagaatgatcttgtgcctagcccaggagagccagggttctccctgactccgccctggagtccccttaagcacttaaaccatctgatggggacaaatggagaggacagatgagggagcagggtggagcgttttagcagaatgctccttacccagaacccgctgctattctgcagccagcaaggatgtggggctaagaactaaggccagggccttacaggaaaaaggtaaagggggaggggtgggaatttaagctcattttcttccccaagtatccaaaggtctcctggatggagaagagcactggagtaaaaaccccagtacaaaccttactggggacagtgggcaaccttgtcgggttagtaaaaacaaatggtgtgggccctggaaaatgagggctggaggctgtgaataaagcagtggatgtgtttgttcagtacaccaacgggaagaagtacccagatgggaggagtactaggggcaggagaaatgccagacagactctagtgccagggcaagaaggaagatcattttgtttgcagaacagggagggcacagggatggtgctaacttgttcttgtgatggctctgagctcctacctaacaatgagaaagcttgctccttcttcccttcctggatgacccaggagccctgggctgggatgcagtgacctcatttccagccccttcccttctggtgatgaacctccctatcttcactcagaaaacagacttggattagaggcactgcacagcccttccaggattctaaaggaggaagagtttctttttctgtttccaaagctgcctgctggaagaggatttcaacagccatcccagtcggatgcacagcaggaccatggaatttcccttctgcaccatagggacccaccctccactctaccactgtccataaaaactgatggttttttttttgagacagagtctcgctctgttttccaggctggagtgcagtggtgcgatcttggctcattgcaatctctgcctcctgggttcaagcaattctctgcttcagcctcccaagtagctgggattacaggtgcctgccaccacaactggctaattttttgtatttttagtcgagacggggtttcaccattttggccaggctggtcttgaactcctgacctcatgatccacccacctcggctttccaaagtgctgggattaaaggtgtgagccactgcacctggcctaaaactgatgtttttttctttttttttaacatataacttgggacttctcagcctcctattctttctttttttttttttttttttttgagacagagtcttgctctctcatccaggctggaatgcagtggcccagtctcgactcactgcaacctctgtcttctgggttcaagtgatactcctgcctcagcctccccagtagctgggattacaggcacacaccaccatggccagataatttttttgtattttcagtacagacggggttttgctatgttggcctggcaggtctcgaactcttggcctcaagtgatctgcctgccttggcctcccaaaatgctgagattacaggcatgagtcaccaagcccagccttctttcttttttttgagacagagcctcaccctgtcacccaggttggagtgcagtggcacgatcttggctcactgcaacctttgcctcccggttgaagtgattcagtctcccaagtagctgggactacagtcacacaccaccatgcccggctaatttttgtatgtttagtagagatagggtttcaccatgttggccaggctgacctcgaattcctgattgcaaatgatccacctgccttggcctcccaaagcattggcattagaggtgtgagccaccgtacttggcttccttttctatttttgagacagagtctcactctgtcactcaggctggagtgcagtggcacgatcttggctcactgcaacctctgcctcccaggttcaagtgatccttctgcctcaccctcccaagtagctgggattacaggtgtgcacctccgtggctagccctccttttcaattggttagtgtcttgtggttttcccacctttccacagtggaaaatggctcaggactgactgacatgaagacaagcccaggggtctacactcaactcaacccttgcacccaagctctgggctaagattttggcgtgctgagcaccacccattttgtaaggaattttgtaaaattttatctgaagcatcactcacaactccactttctttacttaaataaggatttccgccccatttctgccaggcatactgagcttcacagtccctgtttctttttcctggtgcctaggcctggttctctgagcctggtggtcacaccaatggcatctggcacacagttctccgataatggggatacctaggaggttccgagacaccttacagtcctgggttagtaacctggatctctttttccacctctttaggcattttataatctagctttcccccttcctgtgggtaaagtgctcctgaatgcttatggtccaaaacaagacttctttcctatctattcccaaatctttctccagatccaccctagaggaagggaacagaatcttccacattccagcagctggtgacaggccagaacagggaagaggtgagggctcagctggctccatacaggagtgcagatggaggagcaggatctctctctgcctctcaagttttcctaaacatacttctcaattcctggcgaggactcttccctctccacatcctcccctagtctccccaaggagggagcaggagcattcgaacgcggaaatcgaggtgctagtccaaactgctcggtcggctttagtcatagctggataatgcccggctcaggtctaccacaagccatacagctgctttttccgtgttcaacctgtctgtgacagaaaccaagggggccccggcacccagcatctaggcggtggaatcggggtcttacgcacggttccgcgggcaggtccccggccaggacccgcggggagccacgtagccaggagggtggggctgcccaccgacccaggacgcggcaacggaccggggagggcggagctccagcgaccgcttcccctcccgcccgccggcaccccctggctcccacctggtcccggcgcggcctgcgagctagcgaggttcgcgcggtgaagtactgctcgagctccgagtccgagtcctcttggctgcagtagccactgctcgtcgtgctgctccaggtcatttcgaaagaaggcgcctccgcctcgcccatagccgtacccgcccgtcccccagtcctgcgcgtccgtagccgccaaccaccgccccggtcgcgtgcgtgcgtgtacgcgtgtcagtgtgcgcgtgcgcccgggccagagccgcgccgcaaccgttaagactgaaacgtagatcgccgggatctagctcttgtctcattggggcaggaacgccggggcggggacacgcacgcttcgcccccaggaatgacctcatcgctccggagctccactcacagaccccacctaccacagggaacgggggcgggtgccagcgtccgggcaagcgcacaagagtggcctctggccggaggcgagggcgggaaggtgcgggaagtgcgcgtgcgcggagcctgggtcagcctgggcccgggtccgcttgcagcgggtggagtacttgcggagccggcaatccaggctcccctcccagcccccgcgcagaattagcctctctgtgccgccgggaaatcggcaattagaacgctccttgcgcgcggcacccaggcagccctcgagaatgcctgcactgtggcctgcccatcctcgcccttcccatacgccctcggccccgcgctcaccacgttcgtgtcccgctccaccgcgggttcccagcccaggtcccggggcccgcaacagtccaggcagacgagcgcgcggcagcggtagtggcaggtgaacttgcaatctgcagagaggcctggcggtgaggcggaggagctccaggtcggggaaatgtcccggagattgaagggaagccccagggagagggccgctgctcgccaggctccgcaggcccgacctatctcagtgggttacctcacactgctacgcggactctaatgttggccacctgggcgtctggaaaccggccggaaggccacaggcagagaggcctgctcaacagttggatctctatcgcctagcacagaacttcccctttcctcattggcaattaaaaaaacaacaacaaaaaactgcgtcttgcttttgtcacccaggctggagtgcaatggcgcgatttcggctcaccgcaacctccgcctcctgggttcaagcgattcttctgcctcagcctcctgagtacctaggattacaggcgcccgccaccatgcccagctaatttttgtatttttagtagagacggggtttcaccatgttagccaggctggtctcaaactcctgatctcaggtgatccacccgcctcggccttccaaagtgctgggactacaggcttgagccaccgcacccggcccttcactgggaacgtatatggaatacatctgcccatttacttgaaggaaaaactaaacacctttaacctacgtctgccctgtggttgtcacctgtctctactcccctcagaccaagacactggtctctatacactctaatccttcgccttcactctcccctctacccactccagccaggcttgcctcttcctccaggaaactgcccgggacagggtcctcagcgatctgtgtactaccaaatggaatccagtgttccattctccattctcaccccctcagcatcatttgaagcttgctccctttgactcccaggggctacactctcccagttttcctcctaccccctgcagctcctgctcagctcctttgcagattctgactcaacttccatatctcacgatgaagtctgggctcagtcctgatcactggcctggtctgtctacattcatctgccccagatccacggctgaaacactgacctaaaccctcagactagatcctccgtgccagtaccttcactaggatgtctaaaagacgtttcaagtgaacatggccaaaatttaattcccttttcttcagcctcactgctacacttgcccagcttcctctttgcagcaaaaatggccactaggctcccagttactggagacaaaagcccaaacttatctttgatttctcccttgtctctacctctgataaacatgcccaaatcatcctgcttcttatctccatggctactttatttctctttgagaacgctgcaatgtcccagccttgttctttttttttttttttttttttttgagacagagtctcactctgtcgccaaggctggagggcagtggcacgatctcggctcactgcaacctccgcctcctgtgttcaagcaattctcccacctcagcctcccgagtagctgggattacaggcacccgccactacgcctggctcatttttttttattttttagtagacatgaggtttcaccatgttggccaggctggtcttgaactcctgacctcaggtgatccacccgcctccgccttccgaagtgctgggattacaggcatgagccaccgcgctcggccccttgttcattctttgcattctgtcacaactttgtgctccccccagctgaatttgtgatgtcctcttgtaccggatgagagggtctccatgcacacacagacctgggacactatccatccacaagttcctaaataggccagagcagtgatgctcaacccagactccatgttacaataatttggggagtttttaaaatttactgatgcctagggtccactcccagcagttgattcaacaggtctgcggtgggatccaggctagcggggaggactgtaaaagcacccctggtgattccagctggtgtctacccaggggagagcaacctttgcttgctggcgattcccaggggtgcagaaggactgctgggtgtgtggctgcgtgcatattttagcatctgattcactgggtcagaaaagggtgtttgctaaataaagactcaacaaaactcctgcttgcagggggcccaccaaaggttctaaatttttccaggctccctcccataggtggtaatttcccttcaccctaaaggttctggagggggtcatgagtgtttgagaagaggcaagcctgggaagatggactccgaggacagtaggcacaaaccctttctcaagaagggccaaggcattttaaagataagaaacttaaaatcagcgtatttttacatataagcagccacctctgctcatctgtggcccagatacgagtggagtgcgacaagggataaaccattttcgcgcactcttcagcgatggggcgaaagtaacggacctagtcctcgggagctgtccccgccgaccccctctgccgcgacttgacccgcggcgactgcgctgccccttggctgccccttccgctctcgtaggcgcgcggggccactactcacgcgcgcactgcaggcctttgcgcacgacgccccagatgaagtcgccacagaggtcgcaccacgtgtgcgtggcgggccccgcgggctggaagcggtggccacggccagggaccagctgccgtgtggggttgcacgcggtgccccgcgcgatgcgcagcgcgttggcacgctccagccgggtgcggcccttcccagcgcgcccagcgggtgccagctcccgcagctcaatgagctcaggctcccccgacatggcccggttgggcccgtgcttcgctggctttgggcgctagcaagcgcgggccgggcggggccacagggcgggccccgacttcagcgcctcccccaggatccagactgggcggcgggaaggagctgaggagagccgcgcaatggaaacctgggtgcagggactgtggggcccgaaggcggggctgggcgcgctctcgcagagccccccccgccttgcccttccttccctccttcgtcccctcctcacaccccaccccggacggccacaacgacggcgaccgcaaagcaccacgcggagatacccgtgtttctggaggccagctttactgtgctagaggaagagggtccccacatccggccctggccctcctggtccggtttgctgaagcaacacacttggcctacccactgggtggggcaggaagtctcgagccttcacttggggtgaggaggagggagatcggtcagcagctttaccgcccgctctgctctccactgcggagactggggctccggcagaggctggaccgtgatcttgaggttcaggggtgcattctgggtggattcccttggcatgggtggtcggccctcagcaactgcagccctcatttggctctgtcaccctgggctgccaggacacaagtctttccatgcttttcccagtgcttgacttggcactccctgcaggcaggtgggtattgaggatggcaatgcatgtgggggatgtgggagtagggcttagaggtccaaggttctaggataccctcacctgcagcaataccactcattctggcatcgtgagcagcgcttagaagcctctgcactgcagtaagcacagcggggccgctctggagccactgcctctagcacatccagcctgtaggtctcagcccacctgggggaaagtcaggaaggtctgactggccctggaaggtgggggcaccccacccacatccatgcctcctgcatcccctccaccctccctgccatttccacaggccttaccttcgcgcctgcagccgcaggtcctgctctgaggggctgaacacatgctggagctggtgcttggcaattgcctgccacttgcctctgttttctcgctccagccgctcccagatttctgggatctagga

SEQ ID NO: 22 - DNA, 4448 bp, Homo Sapiens
cttatctcttttatgtgtttctcttgctcagccttgctcacttggtgtctttgatattcttctcttttattttactgtctccgaggctcatctcacttcttggcctttaattatttatttatgtaggatgtgaactcctaaatcagcattcaagatgtatatttggatactcatttcaatgtctcagtctcaaactcaatatattaaaagttgtatcctttatgtccaccaccagccccaaagaatgcacaactgaacaaaaccctgaccatcatcctatattttctctctttctgagctatccatagaggtgatcaagatagaaatgtgtgccatcttctattcattccactgtcatcaactacatgtactcatcaaaccatgccagttctacctccttaataactgtagcttaacacctgaataactgaacaaaaacttacaatttaactctcttaacacttatctacctcaattttatttttataatttatacataatctataattatttttatataattggcacagtgataattccagataaaactcactgaatttctatttccatccttgccaatgatacacacacacaatgtaatgctgagagggttgggaaggaagaatgggagaaaggcagaagttgacagttaaaaaaaaaaagtttccagatggttttcttagtgtcatctctgcaacctcatcaaataagggtccaaaatttatgttacaacatttgtttgatgccttatttaaattgctttactggacattttccatctgttaagctctctgaaagaaacaaaattgccttgtcatagctagacctcatgatcctatacacttacaacgggcagactttgcaggggcccacacctttcaaggtggtttgggaaaatgacacagaaaagttttacatcagctgaaaagaaaaatgcataactcattttggtaatttcagttttaattcttaataggataaaggaaacatgcacattataaatcaatgctctgtgttaacaaataatcaagtaagcagagttgcaagtattggctaaaatgaattttggatatttttagctaccaaatttctcgaggcaaggcagacatacatctggacctgaatatctgcattattagggaatttttgtttgtttgttttatattgttttgttatttttaaaagtaggtgccaaattaggtcacctgctgtctgggcaatgttattttttgccataaccacaaattgaagaaaattgactgctctttttccttagtcaacatgctgtgcttccagccccaaacatctttgagaagttgtttagattcatgagcaatgcctctgtccccaacaggctaagacattaggcaggtccctgcacctctggagtcctcagttccctgcaaagtgaggaagctagactaagtaatcgttaggctcccttccagaccgaccaatctgatggtattagatgcaattgctcctgaattagggcatgaaatgaattcagctttggtgcaccaatgtgatgactctgcttcatcaaagcctgagcacgcgataggcctagcaccatctcacacagagacaaagggcaaccctctgcttccaaaggaatgacacaacctgtttctgaagtgattcacatcatctttacttttgaacaacccaatgctcagaaaacaatctaagaatcttcgctgactttagggatgtaagatacggtttcttgacagtatttgggattgtggaaaaaagcaattgaggaaagggcatctccacaacgcaatattgaatttagtgcccaaggtccatcacaggaatccctaacgatccctacaatctctctctctctcttttttttctctctttaccctgaaaataaactgagaagttagtattgggataactattccccttgacccaaataaaaagtcctgggcaaacacaggtacaaattgccaaatggaaaaagttcttctccatcttcagctagagggaggctggggatcccagctctttagaagccggcccgtggacgcccagagaatcccttcggagaccaggtcagggtcactgagcttgcccagcagggcgccgcctcggacgccgccccgcctctcaccttgccagcgccgcgctcgggccgcgaaggtgcgtgcggcgctcggtgattggcggcggcccggagctgcccggctgccattggctgcccggccccctttgttcccgggtccgggccgcaggcccgctgcggcggactgggcggcggaagttcgacggcgccgggcgagtggctgttgagcggcgccgcgggagttccgcaggtttcccgtgttcgcagcggagccggaggccagctgaacccggccgtgggatcccggataggaggaggaggggacccataggacgcgttaacatggacctggaaaacaaagtgaagaaggtaggggggcgctcgtggcgggcggcggctgcttcacctgcgcgggtcgcgcggcgcgcggcggccggaggtgccgaggtgggtggggctcgcgggccccccggtgtgagcccggctctgggtctgcggtgccccgggcccagggacctggccccctgggtagaggaggtgctcggcggccccgccagctccccacactcgggagcgacagaattggaagcgcgagcgagggcgggcgcgggactcttctctccagtctcacggaatcccagtggttgtaggtgttggaaactttacttaagatgtttcagctctgcctgtgcctcctcaaaaggaaaggacgagcttagggcgagtgcgggcgagaccgtgacacttcctggctcaggaagttgaatttcattaagcctttgtggtttggggctctgctgtgctttgacagctctgatctcctcccttccggctgggctgtctggggcgctctaaaatgagtgttgatttaatgcactgccttcgcacccgtgctggtgataacttctaatgtgatttttttttcggtcattcattacttgtctaccgaccgaggcagtgcctccctcttagggaattatctgtcaaagagcgcattctccttgtttggcaggtagtcccaaagggcggttgtcaccagcgtctcagcgcagggagacattttcagcttggctgctgcctcgcaggcactggaaccgacggccctacctgagccactcccgggttatgcggagcctggtgtcgcctgggagaaaagggtggggaccagactatgactcagaaggaatgctgatgtcacattcgagtgaattgccctgtgcgaaagttctcctcgttccaggggatttgctcatgttttactttgtggtaaatttaagctagctgtcccttatcaaatagagaagttttgcagagagaggaagggaaaaatacagaaaacagtttttgtttttctcatactcatggttcctaatattttatcttctaaacacaaagtttttgacttgagcattaattctattttatgcccagaactggatttttgaaaatggatacaaaatattgtgttaggactgcagagttttcggttaggaagctattgaccaataaaaactcgaaatgagaaaacagtttttttcattccttgcgactaaaattctcaggcactcaaaaaggtatccaagaacagaaaaacataaattgttaatggtagcgtgattgcattctattctcttcccatttggtttctttctttttttcttttaaataactgtaatatttttggttaatcttgcttgtcatgggggaaaagcggggaaagcattttgcccgcttagctttctgttgatgaatactactctcatttagttttcaagtaggtaagagctacttaatttagtacttgtctaaaacttggggggtcttgtccttgcttttaagtatttatttgaagacaactttgcaaaagtaaacatattttgggctgccgaggatgaacaggtgaagcacaggatttttagggtaatgacactattctgtatgatactataaaatggctgatacatgtaattatacattaatcaaaatccatagaatgtagaacaccaagagtaaaccctaatgtaaactatgtatgttggggataatgatgtgtcaatgtgtttcatcacttgtaacaaatgtactgcactgatacgggttgttggtagtccgggaggctgctggagacaggaaggcatgggggaggtacatgggaacttcgaattttctgctcaattttgctgtgaagctaaaaaatgctttaaaaataaagtctgtttaatagggggagaaaaatcaaagacatttttgaaactttttgagacaaggagtaattctgagggaagaagttcaaacttaaaaattgtatatgcttgcaaaggaaaaatccagacgttgtttataaacaatttccttagagtttgaaaatgtg

SEQ ID NO: 23 - DNA, 4408 bp, Homo Sapiens
ttatattgtgagcacacaaaaagcactacacggctaacggaggacgaggaaccatggcaaagcaggcaggcaagccctaagaaataaaacaatttgctaaaaaataatttctgatgactaccgcaagactgaaagtgcaggaaaaatacagttcgaataatcccagatcctttcacatttccccccttttcatacactttgttaccccataacaaaatctttaatggaaagtttaaaaataaacagcacaggaacatgtgttttaaatgaactaaattgtgaaattagccagtaaattaatttgtagtaagtaattatttaaggaaattaaaatactgctcagttcagttctgtattttaccatgtgtatgcgttctttacaaccaattaatataagtgctttaggaacatttgaagacaaacacgcttaacttaaggaacaaagcacctaaataatttaagtgtaattttgctgagttaaagtaaaacattccacaaatgaagtggctatttaattttttagggaaagtttggttattgaaatgttgtatgctcatgttacatcaacaaaaatcttcaatttattttgcttatgtgctttgttttcttgatattattggtatttgaattttagatggatttctgccaaaatgatattttgtgtgataaaagcatctttagttttgattgatagactaaaacaaatgcaaggaaatttctttaaatcagattaatttttcataaaaatattttagaatgtatgaattctgatatttacatttataatggtaaaagttttttccgtttagtttagtaagacaatactcacacaaaagagtaaaaaaaaatcacaccaccttatgatagtttgatttctaaattgcttaagaaagtaaagtggttaaactggaaaagaggaacatatttcggaggtttagaatcgaaaatttttttcttaatctccagctggaaaataattctctgcatccatttaaagtgtatctcctgaagtgccagattggagttgactggtgatcaatttaaaggagttacaatccaaagaaatggtgagagcttggcatccaggcctggctcccaggtaattcgcttgggcctgagaggtcactaactgccagttaagatggaatctttttcttttcttttttttcccaatggataacaatgggaagggggctaatcttccagtagctgaaactttgtacccagccctttatcttgagaatgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccgcgtcccactgcttcccggggcgatttccagcgagccgagcctccggctgcacggcaagcgcccgaaagccgggcctgagaggactgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagagcgaaaggagaggggacctggcggggcacttaggagccaaccgaggagcaggagcacggactcccactgtggaaaggaggaccagaagggaggatgggatggaagagaagaaaaagcaatctgcgccaacccggcagccctaataaatcaaagggggagcgccagggcagcggggagacagaaacgtacttttggggagcaaatcaggacgggctgggaggaagcgacagggaaagtggcccaagagacggaacaaaggacaatgttcatggggttgtttgggacgaggcgtgtggagtgtgggtgtgagcgtgcgtgtgtgaccttctttcaggcctgcagagttgaggaaagaggtcacagcaaagagggactgcggagggaggaaagtgagagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaaattgcacgggatagaagtgggggtgggggagagagtttccctcaagtccacatttgctcctgcaaagcaaagagtatgtgaaattacagggcatattctcactcgaaaagtgtgccttacttctgaaccctgattttctgatttcttgacttgagcaaagatgtgtattttggtagtgagcagaatattttggctctgtcctgcctctgagtggaaggactataaatataattcgcctggaggaccaggtgtgaaggcttctgccaggcatatgggacaatgttttttcaatctcaagggcatcctgttaatgtatgtttttggaaagtgccggaacacagccattgctcctggattcggattttcccaccaatattaattcctgcttgagagcaaaactcaggcccgctattaaaaagacatctctttggtccctaattgagaataaagttccctctaaaagttgtattgctcttcctaaatcaatataccaatactcgcaattttagaaatatatagtgactcgggagaatgtgcataaaatagatacgtttaaaaaagcttggcgcttaaaactaaccctagtcactatataggtgctgggctttccctacttttgggggctgtctggaacatgttatgtgttttcttgaattactccgtgttttgaattcatttgagttagcagtaaaaacaggcaaacaaacttgctcaatttgttttgagtgctaaatcccttcactttgaaatagctaacagtcgacagatggactcattttatggaaagggttagcctcttcagccacgaagaaaactgattagagatctacattttaagccatttctaacctccacgtaacatccgtgaaaactcaaactttctctctttacccagtggaaactcaaagcagtgttatttaaggggagagaaatgagggggaaaatgcccacgtgctgtttaattgtatttcctctctgactctgagaatttctatttctggtttttgaaatctcgccgaggcaagaaaatcaaatttcttcaacaagtcccacaactgaactctagttacaggacaccggaaagtgcagtccgagaaagacatcttcacctctgcccatcgacgatttttgcagcctccccattcctctgagtaatgggctaataatcctccctttttttcttttcattttgtagagattaagaggcgctcgtagcagaacggccttgccttcagctggtggcgaggataggcaatctcatggaaaagttggaagagaatgagaaaaccaaagacagaaagattcagagatccgcggagagacacagggagagggaagggagttgcgctgaaaagacgcaaagatacgcgcgtgcaactccctcccctttcaggtttcagaggtttgcaaaccagggctgagaggaaggggctcgggaagctcacgttcctctcgccccccttctgtctggagtctcgcccgccagaggctggttaaccccagtcccggccgccgcagacactgcgctgagcttttgggtcc

SEQ ID NO: 24 - DNA, 4435 bp, Homo Sapiens
gttcccttcctggccgccacggtccacgtcaccaactcacagccacctccccgcctgccatggttccctgttcccggtccatgaaccctcgggctgcccagattggggctgggggtggctgaattgggggcctaaagccattcacatgaaactgtatgcacccccgccagtctggggaagggagctgatcccctggagacccagaacctagaagagagatccccagcaagcagtgggggtggaacctgtgcccctagtgcccccaaacccttcctgagtcctgcgacgtcccccaacccccgcccgcaatctctctccttcgccagccctggtgggcctctcaccggcgcacgagcgggacttccagattttgagcagtagcaagatgatggcgaggaggtgggagaggtctcccaggaatcggaagagattcatggctggggaaccctggcagggctgagcgggagggaggcaggctggcgggggggtgccccccgaggctgctggtctgaacgggtagctgggctggggggacggaagagggaccctaggtgcgctccgctccggggaggggactttgggagggggagcaaaggctggagctggcggcggagctggagccgggaagagggaggagagcgagagggggaggagtccgggaggagaggctccgcccccgagggcggggcctggatccccggcgccccctatcgcccacctcctgctttgccgtggcggcgctaaacgcacccccaaagctgccccataggaacttgggagggtcgcagggttcggaaagtgccaaatccagcaccggttcgcccaggcagtctgtgtctctggaagagacgcagtccagtacaccagcctcagcccttgcagggatgtagagactgccctctgagcttgaaaaatcctgcagggacccggaggctcagctgctagcttttgcagctttcaggcactctaactccaatcccccagaagacaagaaagataccccacctacttcctcccctagacccaggactcaaggccccagcccgttcgtcaaacccagaagtctgggtccccagcccctcctccctcagacccaggagtccagacccccagcctctcctccctcagacccagaagtccagacccccagcccctcctccctcagatccaggagtccaggcccagctcctcctcgctcagacccaggagtccaggcccccagcctcctccctcagacccaggagtccaggcccccagcctcctccctcagacccaggactccaggcccccagaccctcctcccccagatccaggagtccaggcccccagcccttcctccctcagacccaggagtccagacccccagcacctcctccctcagacccaggagtccagatccccagcccctcctccctcagacccaggggtccagggccccagcccctcctccctcagacccaggggtccagggccccagcccctcctccctcagacccaggggtccagggccccagcccctcctccctcagacccaggagttcagggccccagcccttttccctcctaggacgctgttccttggaacttagggtcccacccccaccatcttatggatcaaacatcctaaccttaagaatctagatctacagtttctccctttacgacccacagatttaggccctgattctcttctttttcaggaatgtgcacctcaccctgttctcccagaccttgaggatgaaggaaacaggagcctcacccaggaggctcaaggccaaaactctgacccaaactacctcaggagcccctggccctggcttcccccctgctccagagtttctgccctgcccacacacacacaccctcttccaccctcagaggccccggtgtcctgccccacgctctaccccagagccccacgggtggctttataaaagtgccgggcccagccctctagcaggaggggaatgctgggcatctgggtgtgggacccccggggaacagcctgtggtctggactcctgcatctatgaggggacagacgtggcttcccttccggatgatggggtacccacagatgatggaggccagggtccctcaataaaagaaggggtgcaggcgtgttgatttcttcagagggctggaaggacggggtgcccaagggtgacatccacgagtcttgggtccctgagggtggcttgtacgggggagagtcgggatgactgagtccttaaaagagactccgacttggaggcggtccccaaattcctgggtcccagtagagaaggggactcctgggtctgagggaggaggggctggggggtgggactcctgggaccagggtcgagacctggttttcaggcctggccttctggggcaataaaagccacagcttgggtcttagtgtggcgaacactgaagtcagggaaaggcctcctgtttccagagcctcaaggcagggcgggggcagagggcagcaacccccagccctggagtctagctctgaagctggtgtctccataccgggttctgagtccctgcctgcctgtccccagcctgacttcttcctccctttttattttcagcccctcactcccttgtcccaggaggaaggcagaggctggtagctaggggtggggggcggccccctccccaagcctggcaggagaaggggtccccagggaggccaggagggggggctgtgggtctcccggcagtggcagacggggactgaatgttaatcgcatcccgagtgagtgtgtgtgtgcgagaacacagcgagtgtgtgagtccctcccgctccagctcctccaagccgcggccgccgccgccaccctcgcccgcagcctcccgcagcctccctcggccaccggtgcctgctgggggtgttgcctgggtaggtcggcccggcccccaggggtctctcgagcgtctgccatctgcccggtgaggatctgtgtgtccgggtgtctggggctggctggtggagggggggtgtgtctgtaagcgctgcggcggcggagggagggaggggtctgtctgtctgtaccgaccctgagctgcctgcctgggtgtcgtggggctcccgctccttccccccggcccccccaaacccagatggatggtgtgtacctgggttctgtgcctcctgcctgcgtccggccaggcgtctgggcgtccccggctgcctgtgtcctcctgtctgtccaaacagcccctatcagcagtggcagcctggcccccattagaccccccactctgtgtgtgtgtgtctgtgtgtgtgtccctcctcaagctctgggggtgttgagggggaatcccagggaagtgagatcgtgcgtgtgtgcgtgagtgtatgtgtgtttctgcctgtgtttgagagtgggggagtcaagggggggtctagaggtggccaagcgaggaaggggcaagcagttccccaagcaggcaatctcccgctcctcacacgcacacaccagccactagcttcagaggtgacccagacagacagatagacacagacgctggaagggggggtgggggggctgagggcacaaagcgggggtgcgagtgagccagggagaggcgggactggacacatggaaaggggggaggagccggggctgaagcggcagaggggggcaccccgggtgggcggaggggggatccccacggggtcggggcggcaagaggacaccccgacagcctctgcaatgtccggggcccaacttccagagcaacatgtgtagccacgtcctcgcctagtccaggtggccgcaaccttgggggagagacagggcaggacaggaccaaggaagaggaaggagagacggagccagggacagacaggaggtccgggctgccgctgctgccgccaccaccactgccgccgccccggggcctgccccccgacatcggctctctgagccctcctcggaatcttggggtcgctggacgccgggttccggtcctggcccccccgccatccccccaacagaacagggtcatgaaaaggtaaggcggggacaggggatgcagggatggtggtgggaatgtggacccccaaatctaggacagaggaagttggcaagaagcctcgtggagggagggggtttgaacggtgggcaggggtcttgacccccacctagctcccctgtccctcagggactctcctccaccctctctctctccctctctgagcccctttttcctgagtccctacacctcagacctttcacgcccccatttctctgacacttggctccctctccccatccccacatacctgatgccccatatccctgtgcctccatctctctatctcaccttctccctgtacccccctccctgcatcagtccccccatcgcgagccggtcctctccctctctcctctcgctctcccctcccatgtcagagctatgagtctgctattaat

SEQ ID NO: 25 - DNA, 6001 bp, Homo Sapiens
gggcacagtgtgaggaagaaacatggaaaagacagattttctctagactgaaaaggagattgcccaggggcgggaggaagacaaacagaggtcagtgggtcctgaggctgactgtatgtgtgacttgtgtccctgaaataccatcttggaaactgcaggacccccgggaggaatggctgcaggggatgtcttagcagatgagacaatagccaccgccaccccaccccaaattcctgtgcccctagtgggatacagaagtagtaggttgctcatcaacccaagcagccacatcagcttgggcagtggaaacaactcagccatatcttttgggaacagaggaccaaatggatgtgctgtcccttctcccaacccactacatgggactgtgtatagccctggtgttaggaactaactccaggaaggatgaaggctgactcccttagtctccagtagataagctgctaggggcagctactaatatataataactgagttatttacgtaaaataatggatatgtgatgcttcttgcatgcctgagtttctgggctgagatttattctgtcttgaatgtcgcggttttcttaatgaagttgctgaggaacgcaggggccttgttcattttgcctttttctggaaactttgtcctccaattcccagatccagagcagtgcctctgctctcagccccataccgcccacattctcattaggaaaagcaaacaaaagccaaagtcctgtccagttacaagccttctctaaacggggcagttggactgtatatattcctggcgcatcaattttactcagacagggaaaatatttttacattaaaagaaactaggttaaattatggtagagaatgcaaaattcacagtttaaaaatgatgaaattccagacttcaaaggaacttctttcttgcagggtagggggagggtattctgtttcagaaccccatgcgggtctccactggagttcttttgagaaggacacttctgtggaaaagtttgagcagctctggccctgcgcctggcctggctaggggccaccttcttctggtttgggctgcagcgccctatgggtatcgcgttcttgttaatatctcctcacgtttctaaactcacagcttgtcagcgcgggcgcaacctgagagctgtcgcaggtttccagctcactcgtttcccaaaggaggaaatggagaatcagcgactttaaaggacttgcctggcgggcatccacgcttcccaggctatcgctcctccctgcgtccttggccacctccgttctttaatcctgcaggaactcaggacccacgtgcaaatacaaagaaccgtatccacccacccccggcccttcttcatcctgcgcttccaaccttgggggggtcctctctctccactggggtatctgacgcccgtggggggtgcttagaaaagtttggtagattagtgactggtggttctggaacaaatacatcacagcccaaactgggggctggtggtggagaggtgggtggatgggggctacaaatctgctcggcaactgccctttcagccaagagagaggagctgaggtcctctggggttggaggactggaaccggccagattgcgggctcaaggggcgaaggcaggttggcaggggcagcctcttcccgccgcccacaatcctcgggcgggcgcgcagccgagccggctcggctggctggcgcaatctcgcgcgctccttgcattgatcaaaaatgggggttgaaacagtaaacgcgaggaggagcaactgcttcgactcggctcagaagcgcgaccaatggggatgtgagctccttcgcgcgaaccaattagcgcagggcctgcgacagcacgggccaatggggcgccgactcggcgcaggaacaaggcgggggttcggggccggctgcagactctcaccgcagcggccaggaacgccagccgttcacgcgttcggtcctccttggctgactcaccgccctggccgccgcaccatggacgcccccaggcaggtggtcaactttgggcctggtcccgccaagctgccgcactcagtaagtccccgcgagcgggcgccgggagtgaggttcaggcgggagcacgcacgcgggtgggtttgcatccctgcgtgtggcagtcggattcccgctccctgccttgagtcccctaggcgctttgcatcagcgtgcacagcgggatcagcagctccggcaagcgggcttcgggaagaatgcagttggtgaggaagctcggcgaggcgtgcccgtgcagctgcccctggccctgactgctggtgcgaggcagtgcacgactcagctggccggggcctgctgtcccgccggtgccacgcacctgcagacgcccgggctgtgccatctcctgggccggtccgggggctggggcggggcgaaaaagaaaaagctctgatctctgccttcgcctcgcgcagctgtgcggcgagcccgggcagtgtggagcggatgcatgaatggacatagtgtgaatgagtgatgaacgggaatgaaccgatgacaggttttgcatatgcagtggatcacgttagctgaaagggattgcaaacttaaaggtccgcgtgtgcgtgcccccctacgccttacaccagtgtttgctttagccagcacttaggaacactgcttttcagaaatgtaaatttgaaaaccttcagtccagctttcccctccttgtcccccatagaacctaccctttcctaaagcctttctccccacccccctcctttttttaacctgcttgtcccctaaaggcgttcgagtattctaactctggtagactttgggctgcttaacccaattccctgttcatttcgttctggagtaaaccgagtgattgaattctctcccgggccacaatcagatcttgctggtggaactcactctctgccttcccaggccccagcccggctcctcccctcccccgccaaacccaccgtccccagccccacccgcagtgaagaaggcaaagtctccgatgtgccttgagcccattgtcaggcggctgccgccgccgttagatttttatttttctaaccaggatagagctgataatatgttggagcagcatgaggcatagccaagtattttacaattatcaattgttgagcagagtagaaatctccctgggacagagcctcctctgtgttgtggtaagaacagagaatccaattttaaaggggaaaggacttcttacttttctaggggcagcgctcacagtagctgagaggacagggcttattttttctcagtggttacagttcattttaggcgagattccctgctccagctgtggagatgtttcctgtagcctcctcctgcaccccccatgttttggagtgttcccaacgtttgttccctatgtatttcgttattaatttattactataattgtaatggcaattgtcatcagtaatacaattatttgttattaatttttctgggaggatttttgcccttggactgcatgtaacctggggggcaggagggtgagggggcaggcagatgttgctttttatgtatttccttgatttagttgaattgtaaatattagagaagctttcaaacttcttttgactgtaacctacagtgaaaaacatgtttacaaaatgacaaagtatacacattcaattgtaacaaaaataaatgccttatgaaatgatgtgtagcctaattacctgtgacatacactattttgtattctatcctgctctagtctgttctgtttcattaaaaaaattagtcgtgagctgggtgtggtggcgcacgcctgtaatccaagcaactcaggaggctaaggtgggaggatctcttgagcccaggagtttgaggctgtagtgaactgtgattgtcccactgcattccaggctgggtgatagagcaagaccctgtctcttaacaaaaaaaaaaaaaaaaaaaaaaaaaaaattggttatgatccacaaaagcaatgcattcttcaactggaaaaaaaaaaacctactggattagggaggtgtgatttttcagtaggagtctttaaaactgtttgtaattattttggttataaacttttatagaactattttcaatgaatgctgtctataagaaagatacagtctcaggagcaagttcaaagattattcacagatgaatgtttctctttactaaaagaaaagattcactctattttatttgatcagctggtgctaacaagcatccaacatttcagaaaacaataacacattcttagacccagtcgtcaaggcagtcttttttttaatctaattcttttttttttttttttttgagagaagtcaagctctgtcacgaggctggagtgcagtcgcttggtctcggctcactgaaacctccgcctcccgggttccagcgattcttctgcctccgcctcctgagtaactgggattacaggcacccaccaccaagcccagctaatttttgtatttttagtagagacggggtttcaccatgttggccaagatggtctcaatctcttgacctcatgatctgcccgccttggcctcccaaagtgctgggattacaggcgtgagccaccacgcccggccttgtctaattctttattgttaaaatactgttttttgagacaagttgcaatccagtttaggttatagctgtgttttaatgatgccctccttagcaagcatcttaaaaaaaaaggtgcctcctatctgtagaccttctctggctggttgcttttgcacttattttgtgttcatttttaaagcttttctttttctctttattttttattaagggaatcctcacatacacaaagataaaagtagtgtaatgaacctccaaggacccatctctgagactcaacaattatcaacattgtgccagtcttgttgcagcaccctgggacgaatcttattcacagcaggctcttccttcttcctgcccaccccacgcttcccagtctagcaccttagaccaaaagagatcggaaaattgagttacctgtataatctgggcataatttttttatcgttgtccctttaacccagaactttatgcattctttactttagctttaggagagtggtgaatgagatttgtgaaggggacattttctagggaatcggtaaattcgggcctttggaaaaagtgtatcaacatcagtcacattgcctaatttcatgcttaccttgtgtgtaagttgcataatcgctggctttgtggacatgggaaggaaggagactggctgtgggtggggatggaagcctggggacctcactgtagacccttccttgtcccctcgtcaggtttgtatgttcagagggaaagcagtgcagaacatatttaaataaccctattttcctttatttttttctaggtgttgttagagatacaaaaggaattattagactacaaaggagttggcattagtgttcttggtaagatttacttttgaattctgtgaatgtccatgtttcaaaggaagcttttttttttttttttttttttagaggcagggtcctgctctgtcacccaggctggagtacagtggcgtgatcatagttcactgcagcctccaactcctgggctcaagtgaccctcctgcctcagcatcctgagtagctaggactataggtacacatcaccacacctggctaattttttttaaatgtttaaaacattttttaaagatcccatgagatgggatctcactttgttgcccaggctgatctgaaactcgtggcctgaagccatcctcccacattggcctcccaaagttttgggattacaggcttgagccactgagccctggcccaaagggaactaatttaaatgcatcaaatatagaattacagggcctatagggtcttcctataggcctttatagatacatttttaaactttaatagcttgggttgcatgtctgatagaaaccattttgaaaatagcataaatgctggtgagaggttctgacatctcagcttacc

SEQ ID NO: 26 - DNA, 4001 bp, Homo Sapiens
ctttattttctttacacctgtgtcatatattaaaaaactacacattagagaatttaaaagatttgccaaagttgctcagaaagtgatctgatgctaagatggtgtccttccacttgtactacccctatagcctagaagtataccattaatccatgtcctcctttataacttggagtcacacatggatcatgctgtttcagttatcttgtctaatttgatttctaacattgttattgattctacccctaagtgccccaccttaaaccacagagtgttaaagatgctggatcatttctacaatgttatctctaagcctggtgaaccaagaaattgctagactactttgtgcaacattacaatggcactgctgtaacattatatgccaaatccagaatgtgcaaagatcagaagttgatagcaaactactctaggattcacaacctgtaaaaatgaagtttggtgctatgaaccatgctgttctcaaaagaaatgtaagttcactcctgtaaattttctctttgagaaagtagattactttgatgtgcttttaagcaagacgtacattaccttctaagttagccatttctgttacccagctcttactttgagttttcatgtaaatttgggtctcacattaaaaagaaatgtacactgcaactgaaaatctgctctggaacataattaattgcttttctaacatttttctcacacactacccttttcagcaggaaatggtaaggaatatgactcacttaaaatttcaatgactcttactgcaaaaaaaataataaacttaagaaaaccaaagttgaaattaacatgaaaaaccacgaaccttttataaatgatgaccactcttgtcttttttaaataattcaagaatatagcaatgtattacatgcaatttggttgaccaatattatgaataattgaattggtattaagtcaagtaattatttaaaagatattttcagaaactttaaaagattccttttctaaagcaaaatatctgacttttgactgggaaaaagattgaagagcttaagaaacaaaatatctacagagatgaaagggagcttctgcattcctaagggacccatatagtgtcagcccatagttcttcacacgtgcccatagcctattcttcaacgctaataaggagggacaaaaaaggtcttttattttctagtgtctatttcccaatcagccaccaattaatgctaatgctaagataaccaaggttagctgcaaaaaagtttccagaaactcattggaactaatcaattagacttgggcaagtgacttatcattgcaaattcatgaataatagctagagaaatactaccaactttgatttttgtagcattttattaaagaagaaaaatgaaaacaacgacattcaagaaattccatgctactattcaagtctgcatgagaacatctattcaaaagataatcagaagctatagtcattcagctgaacaagtgaaccactttatcatgggccagcttgaagatatagctatacatcacttaaaaatggataataaaacaatatcataatgtctacttgccctctgtctggctcctggaagccactcaaaagaacgtctttccaatgacatacagtaattcttgaggaaaatttttagatcctgacaggcactcaagcatctcagcaggagacattgggtttctggcttctgttagataacatcttaccctatgatcacagccaaattttacagacttccttctaattcaatcataagtgctgaaaagagaatgagtaaaagcctgtctcagttcttattaaggtatatgcagagactttggaatcttcctcatattctcaaatattttactcctcaattaaagtcccccaaaattatttcattcatattacctttctctgggctttttgcaggatgtgttcagggcggttgactgtggatccgaagagggattttagcttcgtcttatgagttctcagtaactgcagttaatgaagtcctcacctgcttttataccagcagagtgtttccacctgcatctaagccctgggatcaacaggaaattccatccaatgattgaagggtacttggtgtaattaccatgacgtcaatttttaccatgacgtcaatttgatcttatcttgtttcaacccttaggtcatttttgtttggagccattttcaggtgatggtgacgacaaggtcagcccatgaaaagagagtacgctgtcactttgtacgtaattttattgagccatacacataacatcctgaaagctgacactttcctataaacaagagacatttaattagctaagtacctgatatttacctaaacaagagctatagatttccgaaaatagatatagagcatttccaggcttataccactatttaattaggaaacagaaaaataaaacacacacctatttagacttttctaaaattaatttgcatctgaatttaataaagatgcatgagaaaggtatgaggcaattctaagaaggactgaatggttctcaatatacgtgcctggtttttggtttttttttttttctcatttcacttttgtaaagctcagtttctgcctgaacagaaaatatgtatgtcatggcttgccaggtgtgggacacttagctccaaggttcccaacccagtgtcaccctaaaacctgcacagctcttcagactactgtggcttcttttttgcacacagagattatgacccttcaaaagttcctatctttatctactccgctcagtgccacttccgtaaggaactggcttagatacagactaccaaggacctcttcaacaaagagtttagaagatctatgtgatgcaaaaagcaattcttgtttaacataaagaaacttgccaaagaacgcaaagttgttttgtgatttattttctgtgataaacaaatttgtttaggttcttacaccttttcagatttccgttgtttccttccagtatgcatcccaaccattcaccttttcttagtgatgctcctttttgggggacgagtgggggagacggaatctcgctctgtctcccaagctggagtgcagtggcacaatctcactgcagtctacacctcccgggttcaagcacttctcctgcctcagcctccgagtagctgggactacaggtgtgcgccataatgcctggctaatttttgtatttttggtagagacaggagtttcaccatgttggccaggctggtttaacccctgacctcaagtgatccacccacctcggcttccaaaagtgctgggatcacaggcatgagccaccgtgccgggccttcctagtgatgattgatgccaccattattcaagaatttctacatttaaatatcaaccaactggcagtatattttcaatgtagcagacttattttgaaaatctttccatctaggcatttcactcttctttgttctattctttctcttttatttgtgccttctttacatccttttatttcttttttatctgaatgattacatagaaacaatgtttctaggatgctcttattaaattatttttgtttggcttatgatttcatagtggattttatttttatttcacatttctatataagaattatgaatattagggaattcttatgaaaatgtttattgtgtttttaaagtttacatactgttttttaatttttttagtgatgtggctacataaataatacaaaagtcagtgcctttaacacctgacttatcttccccatttcctcaattattctactcagaagcaatgtttccagtttcttacttgtgtttctgcagatactctatgtatatacaaacaaattatatttaagtctccatccctgttgaaattctccttaaaataacaaacagaatacaaaaattagaggaacccctgcctttgtgcttagagaatctctgttggtatggtataaattatacttctctgtactttctacaacaaacatatattacttttataatt

SEQ ID NO: 27 - DNA, 4418 bp, Homo Sapiens
agactccacggaaggggacagggagccgggctccccacaggcacctgctgagaaaggcaggaaggcctccggcttcacaaagtggccctgggcatccaggaagtgttcggggtggaagcggaagggcttcttccagacggcctcatccttcagcaccgatgacaggttggtgatgagtgtcgttccctgggcaggagatgcagggtgagagtggggactggactctaggatgctgggacccctgccaccaaacacacgggggacacacactgcctggcacacagctggactctgtcaactagtcctgcgcccgagaagctccacagtaccctctccgaccccacagcagggcgcagtcacacctctcagaggcacccacactgccccctctccctgcaggcgctgggtcctccaacattctggcaggtcctgatttgtcttccccactagactggggctctggatggacaggccagccctgcctatactctggaccccccatccaagcggggacagtcagtgtggtggcattgaggactaggtggccagggttcctagagtgggcccacctggcagtagccatgctggggctatcaccaggggctggtgctgagctggggtgaggagggcgccaggcctaccttagggatgcggaagccctgtacttcgatgtcacgggatgtcatatgggtcacactcagggggatgatgtccccaaagcgctgcacctcgtgaatcacggcagtggtgcagggcatgtgagcctggtcacccatctctggtcgccgcacctgccctatcacgtcgtcgatctcctgttggacacggactggacagacatgcgtccccacaatgggtcagcacccaggggacactctccttcctcctgtgttggaggaagttaggcttacaggagcctggccacgcctgtgctggaagccccgggtgtcccagctaagcccaggggcccccagctgtacccttcctccctcagtccctgccttgggccccagctgggctcacgctgcacatccaggtgtaggatcatgagcaggaggccccaggccagcgtggtcgaggtggtcaccatcccggcaaggaacaggttacccaccactatgcgcaggttctcatcattgaagctgctctcagggctccccttggcctgagcagggccgagaggatactcaggggatagaacggggtagcccccaaatgacctccaattctgcacctgtcagcccagatgcggctcgccgggtgatgcactggtccaaccttttgcccagcctcccctcattcctcctgggacgttcaacccaccacccttgccccccaccgtggcagccactctcaccttctccttctttgccaggaaggcctcagtcaggtctcggggtggctgggctgggtcccaggtcatcctgtgctcagttagcagctcatccagctgggtcaggaaagccttttggaagcgtaggaccttgccagccagcgctgggatgtgcgggaggacggggacagcattcagcacctacaccagacagaacggggtctcaatccctcctgtgctctgcgttcacctggaccagtctcaggccccagccatctccaggaagacccagggcctgcctgtccttaccactgacctcaccaagtccctccccaagtgccagcctccaccctctctctccttgcccagaggagaaacctaaaatcgaaatctccaacgtggacgggggtacagagtccttggcctctcctggtgccccctgacccgggcacacctctcccacgaccatgtctgagatgtcccctcctcctccaggcccttcttacagtggggtctcctggaatgtcctttcccaaacccatctatgcaaatcctgcccttcggaggccccagtccagccccggcacctctcaggagctcgccctgcagagactcctcggtctctcgctccgcacctcgcgcaggaagcccgactcctccttcagtccctcctgagctaggtccagcagcctgaggaagcgagggtcgtcgtactcgaagcggcgcccgcaggtgagggaggcgatcacgttgctcacggctttgtccaagaggccgttggggcgaaaggggcgtcctgggggtgggagatgcgggtaaggggttgccttctccgtcccccgccttcccagttcccgctttgtgcccttctgcccatcacccaccggcttggtcggcgaaggcggcacaaaggcaggcggcctcctcggtcacccactgctccagcgacttcttgcccaggcccaagttgcgcaaggtggacacggagaagcgcctctgctcgcgccacgcgggcccatagcgcgacaggatcacccctgggggcgggacgggcacgtgggcgttgccatgaaggccttggccccaccctccgccacccactccaaccctggcgctccacaaggtctcccgcagtccctagcccggtccagctgggcacagggcccactctttgctcacccacattgctcccctgcctggggcggggtttggccccacctcgtctctgcccaccctgaccacctttccactcaaggaagatcccgcccgtcccgcccacactgagcccgcagcataggcgcggtccccgccaccgccacttcgacgcatcagcctcgcccaccgggcttctggcgggtctgggcagtagccccgccccctcccagcccacagactcgcacctcccccgtgcaggtggtttcctggcccactgtcctcagcccactcgctggcctttatctctgtttcacgtccaggaccccacgccctgtcggcgctgcttgggctacggtcactgtccacccggggcccacggaaacgcggtctctgtcccccaccgccgcttgccttgggaacgcggcccgaagcccaggacctggtagatgggcgcaggcgggcggtcggccgtgtcctcgccgcgggtcaccatcgcctcgcgcacggccgccagcccattgagcacgaccaccggcgtccaggccagctgcaggctgaacacgtccccgaagcggcgccgcaactgcagagggagggtcagggcctcttgtcaagccaggatcaccccagactacaggtcctagtcctatttgaaccttggacgacccccggggctaccaggagtgagcaggtggaaggaggagacccagcctcctgatcctggggcgggggtgggggtcacaccttctgtgatggaggaactcagtttggatgcgtcacccaggtatgaccttgcaagagtcaccaaaattgccgagaggccccagttagcatcccattcccagatgatggtccatgccggtgagcagtgaggcccgaggacccacagtgcaaaaggtttgaaccgggtcactgcacccccttcatcctcgatttcgtgatttaaacggcactcaggactaactcatcttccattcccaaggcctttccttctggtgtcagcagaagggactttgtactccataacatatgttgcccaatgggcttgcatgcccactgccaagtccagctccacctccaggcccttgccctactcttccttggcctttggaaaatccagtccttcatgccatgtataaatgtccttccccaggacgtcccccaaacctgcttccccttctcagcctggcttctgatccagcctgtggtttaacccaccacccatgtttgctggtggtggggcatcctcaggacctctgccgccctccaggacctcctccctcacctggtcgaagcagtatggtgtgttctggaagtccacatgcagcaaggttgcccagcccgggcagtggcaggggacctggcgggtagcgtgcagcccagcgttggtgccggtgcatcaggtccaccaggagcaggaagatggccactatcatggccaggggcaccagtgcttctagccccatggctgcctcactaccaactgggctcctctggacacacctggcacccccaccccaccaggcacagaggaccaggcaggacactctcggcacaccgagcgcgtgacccttcccttataaagggagctgatgatggccttcgccctctgctgtgagtgaacctgctgtgttgactgtgctgccagtggcagagtcaggccagggcaggtatgggctgctccagaggtccttgccgctgcttcctgctccaggcccttacccagggtagggtggtagaaaggcctggtcggagaagtcaccccctctccccactccaagctccccaagcccacacaggcttctgggataaccagggtctcagtggacccggccatccacctcccagctaggctcatacaccctaatgtagtcacaacccctcctccagaacatgaccttgccctttccctacccccacctgcccactc

SEQ ID NO: 28 - DNA, 4398 bp, Homo Sapiens
ctgtctcaaaaaatattttaaaaaaataaataaaagaacatctactaccaccaacagaataaactgtgatatatttataaaatgaaatcccacagaagaataagaggataaaaggaattaactactgatacgtacaacacggactaacctcaaaaatattttttgagcagccagacacggcggctcacatctgtaattccaacattttcagaggcaaaagcaggacgattacttgagctcaggagtgagtctacagtgaactgtgactgtgccattgcactccagcctgggtcagagctggttccatttacatgaagttcaaaaaaaggcaaaactatctatttatgatgataaaagtcagaataagaaggtggcagggattgacagagggtacaagggaacttcctgggatgatgtaacatcttgcatattgagggaggtgtggttatacagtacatgggtttgtccaaactcatcaaactgtaacatttaatatccatacactggagaatacatttcatagaagcagatgatagaaatggccattttctcacataatctgtaaaagaagtgcaacactgctgactattccttccttacaagtcattaccaattcggtttcagtgagaccacactggtttcccttctcatccggactattctttaaacacattctccttctccacccttccctcatgtttctatactctaactataatccaacctttcttccctacaaattaccacctatgggctgaagacacccaagtttattaaactccatattcaaaaatctagctgctaccaagcatgacatatcacaaactcaacatttataaaccctaaactcttccttcccgttcccaccgcaactcccccactaacccccgaaaaaaaaaaaaaaaacttgcccttcttatctgagattagaatcatctgtttttgtttttagagacagggtctcactatgttgccccaggctgatctcaaactcctgggctcaagcgaccctcggcctcggccttccaaagtgctgtgatttacaggcgtgagccacggtaccagacctgaaatctttcttaaacatctgcctcttgggcaagctgcagtgtcccacagaaaaaggaaatgaagcaacagtaatggagtatcctttacacctcatctgggcccctcactactgcagtctaactgcgtatctcaccgacacttcccacacttctctagaggattaggagggaatatactatctcagacagcttctggtgaacagttaacacttatccagaaccaaccacctgcccaaactgctagtcacttgacacacttcatttaatgtgtactaacgccgccctggatgaaactgagctcacaataaattaaataacttggccaaggtcacacaattaaagcggaaaacgccatgatttgaaaaggcacgtctggggctctaaaatccctcatgtttacccccaacacatgctggagagtcaaactccaattggtagaatctgcgtgaaatggaatacttttcagacaacccaaacaacgagcatctgtcaaatattttacaatcgggaaagtgtaacctcgctgcatgcaacttccctccctggacgtgttaagtaacctgttaaatttcccaacccagatcatagccccccaaccccctgcaccatggtttctctaaacgcctttatagccccgcgctctctaatctcgagctcaagtgaggctgcctatggggctctggcagatgacaaacgacaaggaggccgaaagccagatgtcttcgaattgagggagaaggccggacctctgactcgggtcacactggggacccccacaaaccatcccttttagacaagtgaccccgggggtcaccttgacccctgcagtgagccagaccaaacttccacgccaggccagcccccgccaggtgagcaggtacacaaaaagaagcctcagtgaccaccgtacgctggtgtggagaggccccgggaggtgcaaggagaacagagacgaactcgaccgcgggcagaagcctcccctggctccaacgccgcgactgcctgtcgccgaggctagggccgccacttctcatgtccgagctggccaggcgccactcgtacctgcgggctataggcctccgaagcccatgctcctgccaacttctgcgtgaagccactaaacttgtagtacatgacgcccagagtccggcttcccgcatccgctgccaacgcgaccgccccagagaaggaccccgcctccccggctgtggtcccgagactcagcgcaaggacccggtgctgggactagggctgcccgaagatcgcctaacttaaaacctgcacacttaagccgcattggggaaccaaaagccagggttctcaggaccacgaaaggcaaaaccagctctaagagagcacgcaaagtcgctgtggcggagtctgtaggaaatatgaagttccctctttcccccattcagatttgggcagtgccacgacaactcaagaaatgcgcaagcgctccacggactaagcccggcggactaagcccggcagtgtcggagtcaggtggagcatgctttaggaggggcgggctccaggcggggcctgggggggagagggcggtgattggtgggcgtggtctgggtaggggcggggctacatcgaagccggttgggaattccaccatccgagagagtctgtgctgcggagccaccgtctggtcgtcgggttgaaggcgtctcttgctttaccgaactttaactgatcgtagtctcatttatttccttccgacctagagcacctcttatccagaagccaccacctgctgttgctcagtctgcccaggagtatagacttgtcggccaagcttcccctggcaacctgggagttgaagcaaataagaaaatttggaagcacctgctgaaggctgtttagtacccagggctgttgggagatttgccccaataatataaaagtagcctcctgggctttgtgcagaggaaatacacatgcagagtgatctaaagctcaggtaccaggatgtaaatgtcacacggtttctcagaactggtttttattctcacctgagttttaaggtcattgattattcatccttttcctggcctctgctctttgcgataaatgaggtagggggagggtgatcagaaacacttgtaaaatctggaccttgagcctgaaagatctggaactaccactttcagttctggtagtattcgcttcagttcaatttaaatatgtctgttaagcctgtgctgtgtgcaaggtactgtgtaaaaggagtatactagtttcttactctccagggatggactcaggcttttcttagcttcatcatctaaccataggtttacacaagcatattctagatgcacttatgaaatcatgttgcaaattgatggatgatactaacctatatatagcattgccctaaactcatttaatcttcacaacaatcctataaggtaaatgctattatcatctccattttagaatacaggaaaatgacgcctggagaagctaagtaacttgctcaggtcagggataagtggcagagctaggcatttggctcaagacttcctactgttaagcactatgttacaaataaatagatatgaagccattctgaaaagaggaggatcaaggctgagcattccagggtgagggtgtacaccagcatcctggttgcaggcttacgttcaagagccccaagtattcagcaccgccaatatgttgtaaaggtttcagcgaattcatgtaagccagcccaaagttgccacttttacaaagagacactgtgatataatggaaagaacatgcaatttgggtttatgtccatatttctccaaggataagtggtttgggactagtgatttccttttttttttttttttttttaaattctttttgaaacagggtctcactctgtcccaggctggagtacagtggtgtgatctcggctcattgcagccttgacttcccaggctgaggtgattctcctacctcagtctcccgggtagctggaaccacagatgcgcgccaccacgcctggctaattttttgtatttttagtagagatggggtttcaccatgtttcccaggctagtctcaaactcctgggctcaagtgatctgccaaactcaagactcccaaaatgctgggattacaggcatgagccaccgtgccaggcccaccccatgttttgatactgaatagattcaggaagatttttctacgacaaaaagttcgactacctcaaaagaaaatgatccattgacattagccttcttgagtcccaggcgctagcaaatattgagtgaaagaaaaagcctttcatagagtttagattgaaaagagaaattaaatgatt

SEQ ID NO: 29 - DNA, 4471 bp, Homo Sapiens
aattcatagaggtacatttacagaggctaaattttactgtatgtaaattatactgctgtagcctaatttttttaaagtgctattgcatataaaacaatgtgctagacactgaattatgaaatctaacgttcaagcatacaattctcaaggtttctagatgtattatcaaaaacttatcattaaacactttgagttcagccttcagtattttatattttatccatatttatattctataaaacgactcaaagcatcacctaaaattatcacatgaattttgaattattatgtgttcaacatacacttatagaaaatttccttcttattcttaaaagtgaacatatcaatatctattaaatgttaattatatggttatgagttgaatttactactaaattctaccttttctgaattataaatacattaagaaatgtaaactgtgattagatttattcacatccctcagaacactacgaaatgtgtcctaaacatgttaattgatttcagaaacttctatgtcttgagcaagacttaagtgttaacaagcatctgatggcttttaaaataagaatgtttcagaaattcatctaaaaaaatgcttgaacgtaaaatgcaatcctacggtgtatactctaatgcctgttgatgaacagatccttatagtttccttcttctagaactcatatcaaaatacattttcttcagaaaaaataggagtcaaagatgttaatcatgttcttttcatagtcacgttacatttgttttacaacactctcagaaaagcctttcctttcacatgttcactttttaaattacaaacatgtttcccctcactagacaccgagttacgaaacttagagcaaaagtaaaactttctaatggaatgcccatgtaaatactagaaatataacaaaataaggcaaagtctgtcctccaaaatgttgcctaccacaccaaaacacaatcctgctttttaaacagcgagtaaaattaaatcaaccttatcttcctaaatagaagtccactcaaagttttttcacaaaaatgacattcacttgacttaatattgtccttccaataagaataacacgcagggtgttagagggcagttgttggactcctcttcagcaaataaaggagaccagttagagcttagcttggtctgcccaggaaaggaggaacgcagcttgctgacatggctaaggaatgccaattaatacattttaaaacccctatcatcttgcctgagacgtgtacatcttcccaggccctcaaagttcaatcagaaagtgtattcaactccattgtcatttcacccatagtggggaagtccatcgaggaaaaccatagggaaataaaatgtttttcagttattcatattagcacaatcaacccagagctcacggcacaaactaaataagttaacttgccagtgtcttgaatgaagacatttaatcaaagcatgcattttccaactttccagtagctttcaggacagttggttttggtgatcgttttttggtcttttattgttctcaacacgactggtttctcaccgcaggatttcaaacaaaatgagacaattaaaccacacctcgagcgaaggggcgcttaccttgcagataaacacaccggccttgccttctctaaaatgcggacacgtgcttttcccgcattagggggggtctcccggcgcgcgccccgccgccacctgttgaggaaagcgagcgcacctcctgcagctcaggctccgggcgccagccctgccccgcagccccagagcccgtcgcagctcgggtggtccctccccggcccagcgctcgccgcctgctcttcgccctgcaagtttcaagaggcagttatttctcgcagcctccgcgcttgcaactgcctcctggcgggggagtgggtgtccaaaaagccagcagctggagaaactgaaaagatcacaagcgacttaacgataagccccttcttccttttaaagaccgagaggagggtagaggggagtagtgcctgagcccacgtgaccgagccagggagcccgacggtctcaggaacgcccgacgccgcgcgtgacctctaagtgggagcaccctcgaaccgactcctggtccacccacaaggatagtggcgcacagatggcgctccccgcagccccagtctcagatttaagaggtctggagtagggcctgagaatatgcatttccaaccaggtcctgggggatgccgacactgatacagccagtctggggaccacacttcgaggatcacgtcctcagcccctgactcacataagtgtcattcagaacagatgtctgattctaaggagccagtggtgaaaccagagaggctttgggtttgtcaaatccccagcagcaaacgtaacctcgggccctggagtggcaaagccgtggactagaggtggagggagtgggttctcagctctcaagaggtcactgggaaggcctttcgcgttagatcaaagatcccaggtacttcctcgaactcacttgaagtggcaccggggagacctgtgcctccggccacggcgcccttctccgctggaggcacctgcccacccctcttctcgggcgaaggcccctcgcgccccctggtggcagccccagttcccccagcttaatggggtgttcccctcacccaccccagcaggagccccagggtgcgagactaggaccacagtcttaactggctttaaggcagctgttgctgatgaaaatgaaaaggaaagtagcatgtgacccacaggccattgtgagaaccccccagtgtcacatctgtgcctaattaatcatcaaaccatctactcaggtggcataagggacatggtttttgagggttgtgatccagatctctaatagaggaagacgagggggggcatttggagggaaagttttacagtaccagcctcagctgtttggtgtttagccaaaatagagagacgcaagtgtgctctgggttgataaagatgaggtccacaggtaatgaagacaggctccaaagatggagaagcatctgcttcatcagctaaacaatagctgtgaaaagtctccactgccccaccctaagtccaattttcattaaagctgagagtcctggtttctctcaggttgaaaggcagagtctccctgtccttgaggcagagaagttagtttggacgggaagagtgtgtcgctggcaaataactgcagcagacaacatgccaatctcagcctccctgtctcctgtcctggggtctctcaaagtacccagtccccatatgctcttcctccttgccaccttatggagaaaatgttaaatgatggtttaaaaaaatcagcttcatggccaggcatggtggctcacacctataatctcagcactttgggaggccgaggcaggtggatcacgaggtcaggagtttgagaccagcctgaccaacatggtgaaacctcgtctctactaaaaatacaaaaattggctggacgtggtggcacatgccagtaatcccagctactcaggaggctgaggcaggagaatcgcttgaacatgggaggcggaggttgcagtgagccaagatcgcgccactgcattccagcctgggcgacagagcgagactctgtctcaaaaaaaaaaaaaaaaaaaaaaatcagcttcatttggtggtatatacttgttaacaagatatctctggaaatggaaaccgtcatgaaggaatttcaaccataagccaacaggcagaaaaagataggtgagggtgaagaaaatgcatctatcaatattaacatcatacctgacgctgtgctaagcacctgcacagcatctcatttaatcctcacaccagctcagtgagatattgactccacttttccagtgaggaaattgaggctcacagagcttctgtcagctacctgaagccacctagtgagaaaggaacccagtaacaacagtggcttcatagacagctaccgcttattggacatttatgccccgctttctctcaataattcttattttatacgcaagcctataaggcaaattctattacccccattttatacttgagaaaatgaatgttcaggaaggttaaacaacctccctatggtcacatgacctatcagtggctaagaaggacttgaatccaggagagaggccaaggacccatttacctccataccatgcctccaatcaatcagaatgaaaatggcttgactctctgctctatgcagaacactgcagacaaacttctgccacctgtgtgccaagcttctgctctgtgttcactgtgatgcttccttcagaaggcattctacacacaggaacagcatgttctcttttcagagcagctcaaacacccacagaagctgtttattatacaaggaaacctcactgcaggaaataataagcagaaaatgaatgggagtgagtaagtttccttctgactcaccctgtccatcaagaaagacaatgg

SEQ ID NO: 30 - DNA, 4479 bp, Homo Sapiens
cggtggctcacgcctgtaatcccagcactttgggaggccgaggtgggcggatcacaaggtcaggagatcgagaccatcctggctaacacggtgaaaccccatctctactaaaaatacaaaaaattagccgggtgtggtggcaggcgcctgtagtcccagctagtcggtaggctgaggcaggagaatggcgtgaacccgggaggcggagcttgcagtgagccgagattgtgccactgcactccagcctgggtgacagaccgagactccgtctcaaaaaaaaaaaaaaaaaaatatggctgggcgtggtggctcatgcctgtaatcccagcactttggaaggatgaggtgggaggaccccttgaacccagaagcccagcaaaaccttgtctttaaaaaaaaaaaagaactgtgcacaaagatttcagagagtgctaaagattagcgcatggataaggaagttctgtgaagagttgaagtgctaggtgaagaggtggcacgggggaggagggggcggaaggggagaaagggtgtcacgcttcataacggtctccaaacctctttgtccaggaggaaatgaagtcatctgctctcagcaatcagcatgacagcctccagccaagtaatctggagtcatgagagctgctaggggagcaacatgaatcatgacggtccctgggaatttcctgataactaacctgggagtttcggggtaagtcctcaggctgcagcatctctgtttatgttctggtcacgtttatttacaattaatgggttctcaaatccaaacaaaactgaccacagtcttctagaggaagtagcaaggttggctctgaagcctatagcatcgctgactcagtctgtcccctggaaggctggcagctcagcaagcacagaagtctctccagaagacagtgggtcacctgcctcccaaaagctgaaaggctaacttgtactttccccagcaggcagctggcaccctgagccctcggctggggcagagcaaaggagccttcctccttcctaccttcctggcactctccctgccttccttctgtcactctcaggtggacccagacccaaggtccagatttgcaaggcaggaaaatgctgcaggcctaggctgggaaagggcccaaagccgctagtggattgctgggactcagcctcctccttcccactaagagagcgagtcctactgggttcaaaatgaccccaagccctggttcctgacactaggggaaagagatgggggtgacagaatcacagaatccctgctatgttcctccaagtgtgcccagagatgcgtgtgtgtgtgtgtgtgtatacacaaatgtctgcttatcctcaggcaggaagggtggatgcagtcatttacacatggtctgtttttctggaggacaattttatttgataaacaattgtttctatctgaatagaataaacaaggctctatgatgaagtaaaacactaaatacacatgcattaaaaaatgcataattatctttttggaatgggctatacagagatgtgctttttaaaatgttaagagtgtaaaaggacaaacagtgaaaaataaatcttcctcttattttgtcctccagtctcccaattcctctactcagaggtgagaacagaacttccacaccctccagaacctccacagttagaactgtctacatgtttccattgtctttacttttattcttgcctgcacaaataaatgaattgctcattatggaaacttcccaaaagacccgttaacacttcaataggaagcaccaacagtttatgccctaggactttgttcccacaatcctgtaacatcatatcacgacacctaacccaatccttatcaagccctgtcaaaaacggactttaaaccaagctgcaaattttcagtaatctggccttgcctttccccctctgatagcaccatcaaacaaacccccttactgccgaaagcaataagcccggctttgttccatccactggttgtgttggtgatatctggggactgccactgaacagacgcacagagggagcccctacaggcaggggtttttctgtctgtgcttctgggagagtatgtctcgtacatttgtcgcgttgatgaagacttcacagctccatcagctgcgggcaagggggtctgaggcagtcttaggcaagttggggcccagcggggagaagttgcagaagaactgattagaggaccccaggaggcttcagagctgggcgaggtagagagtctcctgtgcgccttctctcctctctgcaattcggggactccttgcactggggcaggcccccggccaggtgcatgggaggaagcacggagaatttacaagcctctcgattcctcagtccagacgctgttgggtcccctccgctggagatcgcgcttcccccaaatctttgtgagcgttgcggaagcacgcggggtccgggtcgctgagcgctgcaagacaggggagggagccgggcgggagagggaggggcggcgccggggcgggccctgatatagagcaggcgccgcgggtcgcagcacagtgcggagaccgcagccccggagcccgggccagggtccacctgtccccgcagcgccggctcgcgccctcctgccgcagccaccggtgagtgccgcggtcctgagatccccgggccggatgcgcggcggccccagctcccgagcgtctgcctcccccgccctgggctgcccgggctccctgggctccccggcggctgcacggagtcaaggcgccccgtcccgggcgtcccccgcgggtgccgatccaggctgcccggagtccggagcccagagaggagagagacagctggggagcctggtcaccgcgggcatctcccctgcgctgcagtcgcccgcctggcctgccttcccgttcctccgcctcttgccctgacttctccttcctttgcagagccgccgtctagcgccccgacctcgccaccatgagagccctgctggcgcgcctgcttctctgcgtcctggtcgtgagcgactccaaagtgagtgcgctcttgctttgactgatgctgcccaaggacctctgatcagcaccaggggagaggaggggctgctcagggagctggggtcctccggattccatccacagcagggccagactctccccaggaaatgggacagggtggcagcggaggcttgagaaccacgggggttggcactggctggcaagggaggaagaggccgccgggactgccccagcctgcgggcatctggtagatgaagcttgcttgggtcaatccatttctcctggctggaaacccatggtcttccatttgagaactagatacgaacagggtgaggcgagagggagagggaagagtgggttttgggattggggccagtttaccctcaccctggagtccctggagcatgggacctttgatgaagcctcctcccgaatctcttccagggcagcaatgaacttcatcaagttccatgtgagtatccacccctacaacagttggctgcacagacaagttgggaaggcttcaggggacatcccctccctgccctctgctgcagggctgcgccaccccttaccacttccactccccctcgcttaccccacctttgttctctccagcgaactgtgactgtctaaatggaggaacatgtgtgtccaacaagtacttctccaacattcactggtgcaactgcccaaagaaattcggagggcagcactgtgaaataggtatggggatctccactgcaactgggagagaaatttggggacagggagggatgggtgggaggcaagagcaggcaggagttaggagctggaggtagggtgggtgacatcttcatccctatgtgacaagcataaacacacacacacgctcacgaaacagtggccacacaaatgtgaggtggggttggaaggagaccctgtccagtcttctggcaggtctgaaacgacatctttaaaatgtccgttggcagccgggcatggtggctcacgcttgtaatcccagcattttgagaggtcaaggtgagtggatcatttgaggtcaggagttcaagaccagcctggacaacatggtgtaaccctgcctctactaaaaatgcaaaaatcagcctggcatggtagtggatgcctgtagtcccagctacttgggaggctgaggcaggagaattgcttgaacctgggaggcagagatctcagtgagctgagatcacaccactgcactccaactgggcgacagagcaagactccatctcaaaaaaaaaaaataaaagttagttggaatgttcttctctttctcatattctctcatcctcctgtccccttgtagataagtcaaaaacctgctatgaggggaatggtcacttttaccgaggaaaggccagcactgacaccatgggccggccctgcctgccctggaactctgccactgtccttcagcaaacgtaccatgcccacagatctgatgctc

SEQ ID NO: 31 - DNA, 4492 bp, Homo Sapiens
ttgcaggctgcgttcagcccttgtgcaccagggacagcaaggaaaacccaagctagaccagcttcaggggtggcagcggctcctacctccagagaagaagaagacactctggatgggttcacaggtggcaggcacaagccagtccatcctgtagtcatcatagttgttggctcccaagttgctctcctcactggagaacaaggacagccacgtggcgcgggatggccggcgggagttctggttgcggccacggctgtggcctcgttgtgaacggtagcctttgcggttgcgatgcctaaacctttgtttcttggccaaggaggggcggggtgccatgcctgagatgtagatgcggccagccatggctgcgtccacttgccctggcacaccgtgccagtcccggctaatgaactggggctgtctggtaccagctgtggcagggaaggggtgaatgagaggtcttgggggtccgaatcttgccccttccagcggggccattagagttcatctgctgcaccttgcccaaagacacacagcagcgaatggcagagccaggcctttgactctcagtccaattcccttccccctgtgctttccctccaccatatcactggtgtctcgaccccacccccccaggccccctaaactcctcagccacagcccctccctctgctggctgtgctctcagctgtgctaggcaaagtccaaggtgtggggtccaggtagagctgagctttccccaaaaggtcaacagaagcaaagtctggcctgagcaaacagactttgatcgatagctccacaaccacagccccctccagccggcctggctctaccaataccaaggggtttcagcccttttgagggagaagcaagacttgccctctctccataccagaggttctgccccagaagagaagctcgaagatgtcctcccagctgtcccgctgcatcatggcaaagtgttcaaacacagccgacagggagctgccttcacactcctcctgactgggctggtgctggaactggtactcccagtactgtttccctgaggagcagggtggtgggcattaggagggctgggccagggcaagactggagatcccagaggctgttgaagttaggatctcccagcatgaggtgggggtcaggggtgggcacatgctgaggcctgtccccagtgaaatgtgaaaggaatccaagactgctccactgcctgctcagtctcccaccaccccctgagtacccttgaagaagtagacccgctcccggccactgtagctatgggcagggagggccaaggctgcatccacgttgtccgggatgccatcgaagccgtcagagatatttcgggggtaatcagggtccaggacaccatcctcaaagcgccagtactgactaccctaagaggtggggaaagtgaaaaggggtatggaggccgctggctgggcacagaggcagagtcccttgccctaaggcagccgttcccaggtccaggttcactgcccaggacctggagtcttggggctgccctgtgctcacagagctcccaccaggtcctgcagggccctgggtccagcttccctgtccaccctgtccctgggagcaatagctctcaaaccctccctagatgctttctaccctggcccacagcccctggcaccttgaagaggtaggtcttcccctgacagttgatgcgggtgaaggcggcatcgatggggccctcgatgccccagacatctcggatgagcttggggtacccaggcctcactgccttttcgtccagttcatagcagtactgccctagagtggaggagatggtgtgagagcagggacgctcctggggcagacccgcatccccagtacctgccctggattcacctcggaaggcaaagagggaaccgttcttgaggtcggtgaaggcgtcgaagggcttcccactgcacagctcctcctctgctgggggctgaggtctccctggatgaagggtctcaggccttgagtctatcccctcaggcttagaggcgcccacctcaggcgcaggggcctcttcctcaggtttcagaacaggtgtctgctcaggattccctttggactgggcctggaggtcagaggtcagggaggggccccccacctgttcatggacagtggcattgtttttctcctcgccatcgtcatagaccgtgtactcatcctccggcatagtgaacacatccccgcgagtcactgcagagagtggatggtagtgagtctccagcagcagggggcaccccagcccacccacctgggctctgaacacaccttggggcttgcactcagccgtatagtctgtgcagcagctctggtagtaagagcagagctcgtcacactggcacttcttgtccacgttgaagccctcagtgcagcggcccttgcatgactctatgaggaaggagtgtcagtcggtgccaccaagcccagaccaccctcgccctccctacattgacccagatggccaccaacactcccctgtaccttggtcagccagagcaacccatgccagcagggccagtatgagaaggggtctcaggggtgccatggcagggcttctagctcagtgcctggcaagctgggctctggtctccctgaagtctccgctctgatgcctgaggaagggagggagaggcagagacagggaaggagggcactggagaagaggaactgccttttctgctgctctgtttgctcaacctccagcccatcccctctgccccctccagcggctgctgcagcaaaggtcacattcctggaacactgggcctgggcgagctgggagataagacctttgccaagctcagaatcattaggtcatcggaaggggaattagcaccgtggatctggagggcagaaagaaggctcattgggcaacagctttatctctctgagtcttagttcattttcagtaaaataggattaacaaagccttgcttcatggggtgttgggagattacatgaactggaccagacaaaatgcccagtagctggagcagccacaaattccttctccaaacatagctattgatccatgattgtttgatcagacacatccctggctgggtgctcattcgccattatttatttagggcaggaaaaagggagtgggaggagagattgtaagcactctggggaattttattttttagcataaaagaacaaagtttcatttctgggttcttctcttgggtgcatcaatctccccaggctggaaatttgggtaaatatcaacccactggactggatttaatttctgagtcttttctgagcaggccactccctgtccccaggctcagtctccccatctgtaaagagtgggcttgttcaacacacttttagactctcgagagaaatatgatccctctacctggaaaatgcccactggcatgaaacacctgattttgtgcccaatttcaggtgtccacagaacttctgaaatcctcccatcacctgaaaaaagtgatcctgagattttagctgactttttctgttctgtaatcagaggggactgtgatttgggccaatttcttcctcatgggcttcagtggagtcagctgtggaatggaacatcaattcccaccccataggcatgttgtgaggtttcgctaagaaacagccataaaagggccttaagagttatgatgattgttttaaccatttagtagggagggggcatccagcggtgttgctcccacgtaccgatgtcacgtggggcggggaggcggggcggagaacggagagcgtcctctcattctccacccccttcctccaagtccagcgcagggggaggtggctgcgactgactgaggggctagggaaggctggccaggggcgtgggcgtggctggggacggcttgggggtggggctgcgcaggaggctggaggagccccgcgggacccagaggcggggcgtcggcccggggaccactgctcctccggggcgtggctgcaggaggctggaggagccccgcgggacccagaggcggggcgtcggccggggaccgctgctcctccggggcgtggctgctgccgagcatctcccagctcagccgagcccgtgcccaggccacgctttgttccagccgccgcctcctctaccctacggcgtccggagccatccctcgcctgctcgctctctcctttcgcccactccctgcatctgggcctgcatcacctttgccaaccgctcccccgatcctgccgacactcctcccccaaacttctgaccggcacccttgcctggtacccttctctccattcctccccctccatcttctttccccgacccctctcgggtccctcttttcccaaaacccgggtctctccgcgtggccccgcctccaggccggggatgtcccccgcggccccgcgcccatggtcctgacgctgcttctctccgcctacaagctgtgtcgcttcttcgccatgtcgggcccacggcggggcgccgagcggctggcgg

SEQ ID NO: 32 - DNA, 4448 bp, Homo Sapiens
tcagcattccaggagttgatgagcccctacctgggcaccactccctcttgggcctgagaaggccggggggaacctgcaaggaatatgtggaattctatatggtgcctctgatactgcggtaatgtcagggagaggtttgttcaactggtcagggccctgaaaccccgatcactttctcatctctgcatcttgaaggctagcagagaggaggaaccctgagctctctaggaggtgggtaggtggtggcagtacagactcctagatgtctaaacggagttgcagagagaaggctttctcggtagaccctggaagggacttttacggtagaactttcattttacaagcagggatagaggcctagatggggacagagacgtgtccaaggtaaaacaatggacggaggcagggcagggagaggccaggtcctagactcggcctcagcacccctcccacacacacatcgacacagaagctggtccagatttataatttaatggctgtgcagatcccagtccctcatttctgtcgctcacgtgcccactggtctggggtcagggttttctgttcaaaggcatggatgtgcgggagctcttctgctaggcacgcgttcaccagcctggggcgagagatggggttaggaaaaggccagcggtgatcgcacaccccgaggctagggtgacccaagagactggtgtccccaaggttgtagtccccaggccgtgggaacacgtacttggagagagggtctacatcgaaatactcgaagcaggggtcacgaaggcgggatcctcaaggtccctgagccacgccagggggagtgcgggagtcaggttgcaggggtagggggagtggctggggttgtggtacaggagctaggcaaggtgctcccagggccttacctgtgtctctgaagcagcggtttcccctcgaacttggccgacaccaccaggactcggaagctacaggagcaacggttgagggtcgtgtcctccacctcctaccgagcggaagaatatgaatggtgccgaacccgccccccgagctcttttccccttgtccggcggctcaactcaccacatgctccgcctccaggtcccgctgcagcttctcgcggaggtattcggcgctgagttccatggcggcagtccagctggaacggcagcccagcagggacacaaccccagctcgggcgccggccacgctaccttgctgccttacaggagccacttccgctggaaaactcacttccgcccttactaaggcgtacgtcaacgcagtacttccgccctcaagcagccgggctttccagcggtccaggcttttcgcgcttgccatgtgtcagccaatcagagcctgaggaaggtgggactcgggcggagccgatgctgaatggtacgcgctcgccgactggacagcagtctggcttccgcggtcggacttctacacccgcctccagacaggagaggggcacgtaccggcgctacggcttcctgcaggctgcctccggatagtccccgagagcttgttccgaagcaagcaccctgcagccctagcgatccagccctcccctggaccctaggtcacggcaatcaaccccctgctgtggttcccgaaccccaaggcccgatgggtcccgcgggggtcgcggcgaggccagggcgctttttcggcgtctacctgctctactgcctgaacccccggtaccggggccgcgtctacgtggggttcactgtcaacactgctcgtcgggtccagcagcacaatgggggccgcaaaaaaggcggggcctggcggaccagcgggcgagggccctggtgagagggggaggccttctgtgccgggaggaaggcgtcccagaggaggcggaccccgcggggcacaggcctgttgagaaggaccggccaggactgtgacagaggcggggcgtctgtggtggggacggggcctgtcgcaggggaggagcgtgacggggaggcggtgcccggggcatctccgcggcggaactcagggaaggagctagctggggccggggtgatgatccaggctgggttccagcatagggctcttggtgggcacgctggggtcgggtggaatgcaggagagagaggaggtgggacaggtgggtacctgggctggaggcagggcctgaggtgggtaggtgcagagggctgcacttctcggctgaagccgggaatgaggaccccgctctcgggtgggattggaggggacccgcggctgaggcgctgggctgcgacagggacatcaccgttctcctcctcagggagatggtgctcgtcgtgcacggcttcccgtcctccgtggccgcccttcgggtaaggaaggagaccgggcagcggcggccgggtgagggcttgggttccgcccctcgctccgagccgccctgatgcccctgtacgccgcccgcagtttgagtgggcttggcagcacccgcacgcctcgcgccgcctggcgcacgtggggcctcgcctgcgaggagagacagccttcgctttccacctgcgcgtgctggcgcacatgctgcgcgcaccgccctgggctcgcctcccgctcacgctgcgctgggtgcgcccagacctccgccaggacctctgcctcccgccgccgccgcacgtgcctctggccttcgggcctccaccgccccaggccccggccccaaggcgccgcgcaggtccctttgatgacgcggagcctgagccagaccagggggatccaggggcctgctgctccctgtgcgcccagaccatccaggtgaggtccccccgaggaatggatggctctagagtccagacgacttcggatccagctctttcttgagggaaacccactgacacgctttggccaccctatccccatctctaagatgctgatgctataggacttacggccattcctgagcaaagcaggccctgctcagggccttcaccatttccccttcaaagaaaaggttcttccctaggccatcagtactccgctgcactccagtgtggtcgacagagcatgaccctctttttttttttttttttttttgagatggagtctagctctgtcgcccaggctagagtgcagtggcgcgatctctgctcactgcaagctccgcctcctgggttcacgccattctcctgcctcagcctcccgagtagctgggactacaggcgcccgccaccacgcctggttaattttttgtatttttagtagagacggggtttcaccgtgttagccaggatggtctcgatgtcctagcctcgtgatccgcccgcctcagcctcccaaagtgctgggattacaggcatgagccaccgcgcccggccctttttttttttttagacagagtcttgctctgttgcggaggctggagtgcagtgatctcagctcactggaagctccgcctcctgggttcaagcgattctcctatctcaacctcccaagtgtgccaccacacctgccgaatgtttgtgtttttagtagggatggggttcgccatgttgggcaggctggtctcaaactcctgacctcaagtgatctgcccgcctcggcctcccagagtgctgggattataggcgtgagccaccatgcctggacatgaccctgtctctaaaacaatgtaatgaactgcagctcattcttgtgtgcacttttctgcaccccctttcccttaacacttactattgtctggcatgctacgtgttttcttgatctcattagcctctcccaccccaactgccacactgcactatcagagggcagcacttatcactgctgtagaacaaagtcctgcactgagccgatggcccagaaattttctttttatttatttatttatttttttttttgagacagagtcttactctgtcgctcaggctggagtgtagtggcgcgatctcagctcactgcaacctctgcctcctggtttcaagcaattctccttcctcagcctccagagtagctgggattacacgcgcctgccaccgcgcctggctaatttttgtatttttagtagagatggggtttcaaccatgttggccaggctggtctcaaactcctgacctcaggtgatcctgcccacctaagcctcccaaaatgctggtattacaggcatgagccaccgtgcccggcctaaatatttaataaaataatggacgatgggtgccttctactgagctcccggtaattgtgagtgagtagaggacttgccctggggacattcagtgacctgctgggtgttgctgagctgtgaggaagttcaggtctggctgcagtggtgaggctgtgactcaatcaatcactgctgatgctcccaggacctgcaccagcttagtcctaggggcaaggattttaactgtccacctcagtttcttcatttgtaagatgcaaataacagtcacccctgcctcatgggatggagctgtgtaatgcccgcaacagtgcct

SEQ ID NO: 33 - DNA, 4001 bp, Homo Sapiens
gagttcaatgcttgtgatttttctttttttaaaaatttttgaggcaacatttatatccagtgaaatgtacagatctcaagtggatcattccatcagtttgacaaatgcctgcaaggtggaacccaagctcttattagtatctgttaaatccatgttagaggttgatcagagaagcacagcctttaagactctcaccctgctttgcggagaatggcaaaaatctgcgaaacatctcagcagagccaggagagagtaacactggtaacgtgaagcacgtcaagctaagaaaggaagcactgaaattaattgtcctgaatggaacctgataagaatctgccatttcatcccctcaagactggactcaagttgggagagaatattgccttttgccctgtctaagctaatatcactgtttagatctacaaactcccccacctcccaatgtttatatattaacctgcattacaagtcaaaataacacagagaatctggaaaaagaagaaggggaatgtttcccacgaaaagcacaccccttaaagcgtctggcctgagagctatacagcatgcataaaatctgataataagcacattatgacccacattgcatataacaaaaagtagggcacttctgaagggtcctgagaaaaagccctgggcttttaaaacctgcttaagaaggcgatcaacggtacaccactttcaaacgcagcactgacttgtatgctccacagtcatcaacagtgaaaacaacagttttcaacaagagttggaaacactgagttgagggttttttttttctttttaaagtttgaggccaaaatcgatatttattcttttgaattatgcttatatctttttcctggttaatacgcacgcggtggcacaattttgaaaactacgtaacgttatagaaccaccacccagaaacgaatcctgttaacaaactttttgtattcaaactttttccactgcatagtttttgacaatgctttttagacaatctttcttttagcaaccagcactttcaaacaaaaattacagagaatagtaagtttttttcccctcctccggcagatttgacccagaaattgctatgggaagaaagtgttaattatattaaaaaatagtttgacagaaagtatttaaaaagagaaagggagaacatcacgtctttattttggtgaattagcaacaaagaaaaagattagcatggacgggtacttttcaaaaatatattttttttcctctggctcccgctagggtggaggaagttgtctctctgtcagagacagggtggaagagagtgaaaggacaaatgattgagaggctgccccctcccactggtgcaggcgtgcgggggtcggatggggggccgcggaggggggaggtggccagcaggtgcctgggctccaggcccctacccccaccctcgtccccaccctcacccacacccagggattggcctcgccccctggcgggcgagcggtaggtgtcgaagcactggggtggggggtgcaaaccccgcgggcagcggaaaagaggccgtggggggcctcccagcgctggcagacaccgtgaggctggcagccgccggcacgcacacctagtccgcagtcccgaggaacatgtccgcagccagggcgcggagcagagtcccgggcaggagaaccaagggagggcgtgtgctgtggcggcggcggcagcggcagcggagccgctagtcccctccctcctgagtgagagaatgccatacctaggaatacagctaaccagggaagtgaaagatctctataatgagaattactaaacactgctcaaagaaagcacagacgacatcaactaatggaaaaacattccatgatcatggataggagagagcaatatcattaaaatggccatactgcccagagtaatttatggattcaatgttattcctattaaactaccaatgacattgttcacagaactagaagaaactattttaaaattcatgggccgtgcccggggcgctgcccccgcagcctgcggcgcttccgcccgcgcccccgcagggctccccctgcgccgctgccgccgggggctcgggcgcctgcggtccggcgacggcagtggctgcagcgggcacggccgaaggaccgggaggcggtggctcggcccgaatcgccgtgaagaaagcgcaactacgctccgctccgcgggccaagaaactggagaaactcggagtgtactccgcctgcaaggtacgcgctcgccgctctcggaccgcggatgggtgctaggggcccagcccgcgggacccccctccccctcccgcttccacctccgcctcccgcctcctgcctctcgcctcccgcctggggccgctgcaccgcggaagtgctcttgtcgcccgcgcccaattagcttcttcttggataagagtcctgctgggtttgaagaagggggatcactaagacggagagcccttcattccttccgcttgaaaggagtagcttcggcatccgagctcccgggctaccttggggttttgttgctctgtaggagctcgctggagtcactttcccgggagtggagcggtgctctccatgtggcgggtgacccaggggcaaggaaaaatcttttgggggactgagtggtcccttctgcaatcgatcccttcctgtgtcccactgggaggaactgggtgcaaggagtgggggtggagaagactcccggactcctggcgctttgggaaagcgaaggggaggaaagcgcggggtgggaaggtgggcagagtccgaggcgagggtcttgtggtgcctggcgccctcggctgggggcggaggcactgccgcgcgcggtgacagccctgtcattattgtattattacttgtttagttaaaacgctgtcccagctgctcgaggtgtaaacaggatttggcaaagtgacagcccagcgcggcgggcgctactgctcagtttgaggacacccatttcttgctacccactctccatgccagtttaggcaccctgtcacctccagctgcagatccagatgtggaggctgtgttcccgaggtgggaggattgcccgaggccgcggggcaggctggccctgcgctgtcagcagcggctttgttttgacagggtgacagctgaggggggcggggacttggccttgtcagctcctgcggcctgtggctgaggcagggaagagacacactcacacacactcacacctccctgtattcttcctgcctgctgtaaagagggtcaagttcccagattccagattcccgattgtcacaaccaagctgcagtgaccacttctgaattttgacataactataatttattctactagaacatctaggttatactcttcttggtacttgcaggagcttctcagtcacaatggaatgtctatgcttgctctttttccacaccatatgctcaggtttatgttaagcacctctgtatcctacactggttcaataaatatttgttgagtgaatgtaggatctagcccagtgctcctcaaactttaatgtgcatgggaatctcctggggaagctggttaaaatgctgattatgaatcaggtggtctgaggtggaagctgagagtttgcatttctgacaaactcccaagtgatgctatgctagtccacagaccacattccaattcagacctggacaatatattatttgtcccctttgattttagcagaaaagacagaaacaaataataatgctatgtggttatttctgaagaaggaatgcaaaaaagatgaagtggggagtgtgcttctaagaaaggtgcaagcccaggagttgatcatgaagggcattagacgaatgagaacaggacaccgactgtagtaggcagaagggcgagctatgtacagaattaagaacaaggtcatgggtacagggcatactgcttgggtgatgactacaccaaaatctcacaaatcaccattaaagaacttatgtaatcaaacaccacctgttccacaaaaacct

SEQ ID NO: 34 - DNA, 4322 bp, Homo Sapiens
ggcaagtcgcttctcctttctctgagcctcagtttgctcatcaccaaaactggcactaacagcagccctcacctcttgagaactgttcagactgcccacatccagcacccagcacacagcctggtgctgggtagcccctatcagcgatagccatgattattcatttccttcttccatggtgaaccacacggagtgggaacaaaggtctggtggctggacctggagctcctcaagggtcagtcctccctctggctgcagtccctggcacagggtgggcctattgtttatgttgagggagagactgggttggcttactgtggacctgaaggaggagccagaaggaaacccgatcccaagtgggcaaaggtcacttgaggctcaccttgtttaccctttcctccagtccaaccccagggaagccatggggcatgatgggtggggtgggatgggatcaggacacagaacatgctaatgaatatggtccttcactcagggaagtgccgtgcattacaactgggcatcagggaggagggacatttgaatggacacaaccagggcaggtagaggtttgggggtggggtgggaaatggcattcaggcccagagaacagcatgctcaaggcctgggtgtgaagagaaagtctttcccaaaggatagtccttgaacccacctggtctggccttttctccccatccatcttccgcaatctcaaccagggtcctcccacctgaacaacgtggcagcccttctgtcccccatccagcctctcctctgccctgctgtccctctgccccatctatcccgcaggagcccccttgagcctgtcatcctgcctggttgtaatagctttcaccaccttctcattgctctgtgagaagaccaaagtccaatggcctgtctctgtcacaagcccctttctcagctcaggccacctcagggattgtcccccacttccatcccttgtgtctcagctgggaagagctgtctagactttctctatcccttctaggtggttccccaggacctggaaccctcttttttgtctcctgggaagtgacatttctttggatgagtataaggctaatgtcttggctttctgagctctggggacaggggaatggactccctagaaccccaactggtccctagactttgagcctaggggacactcggtgaatagatgaatgagtgaatgaatgaatgaaggagttatggctgacaaccaagttccatgtctggaaaggaggctcaggcgcctgccaggagcaatagagaggtctcaaaggtgggggcaggaaagcagaagactgccaatcggggtaggggcaactgccagtccgagtaggggcagttcccagaaccgcctgaggagcagtgcagcgcccgaccagcgagaacctccgaccctggagtctaaccagctcagtctttggggcagagccgggacagcgggcttggcggcgggcaccgcgcccggccgcgtccgagctccagccaacaggaagagcaggagtggggccaggagaggcgggccagctggccagtggggagtcccgggcgtgggtgtggggagcgggggaacccccgccggcccctcccaggccccagcgggcggagggagcctccccaccgggcctcagcgtcctcctctgtaaaatgggccccttctgagggctggctgcgcgctaatggcgggaggatgcgaagagggccaggcagggcagagggaccgggagactcggtgtcccgcgcaggcagaggcggagggacgctgtccccgattgcagctggcggggcgaggcctggcagggcgaggcctggcgggggcggggcctggcgggggcggggccggcggcacctgggtgaggtcgctcggccccgccccctcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtaagtgagggccgggtccgggcgcgggatcggggctaccccgagggcgcggcgcccttccttcccccttcccgccccagttcccgtttccgaaactgagaaactgagccgcggtcagcgaaagtcccgccgcgccgagacctgccggtgactccgtccccctgtccgtctgtgtgtccctccgctagacagtgggggctgaggtccttctgtctgcccgctcccggcccctccacccgcccgtgtgtctcccgctcctccgaggggcccgtccgtccctcccgactctctcccgggccctgtgtccgtccgtctgtcgccacccactctgtgttctccccctgcgcgcctctccgagacccgatccttctgtccctcgccacccgatccgtccgtcccttgccctccgcgtgctccatcgccccacccccacccacacccctacccccgcccgccgccccctcgatcccgtcctcccggagccgcgcccccggcccacgctcgccgccccctgccagtccagccgcctctccgctctaccgcggggcccaggccaggccgcccgccgggcctcgcctcccgcccctgggtccctggaggcccgacccgcgcggcgcctcctcctcgctgtctcttctttcggtctcaagagtctttctcggtcccttcatccgtctctgggctgggcgtggctccagtctccaccatcccccttcccaccccacccctccgcccctctgagacccctcccagggtggcccctgcccgatacggtctgtactcgcccccaacccagatgccactcccgttgtgggggctccaccagatgaggggaggaggtcgggggggggggtcctcctggctggtggtggagcggcagaaggagagcaccatcggaactgctcccacttccccagttccctctctcttggggcaggggagagccccaccgagccccgccttaaacctggtcagaaggatctgctgtgagtgggcggggggtccccttctctgacgcctaccctgtatgcgtggaagctgtctccttgtgctaagtcactggtatctgggtgtgtgggtatgttgtgtgtctgtgtcagcttctgtgctgtctgtcactgtgggacttgcctgtgcatgtgtgtcctttttcgcatgtgtgacttgcttgtgtgtatgtgtgtatgtctgtttgtgtcctgaggctctgtgtgtgtcttttgcaactgtgtgtaccattcttggtgtgtttgttgtcaccagactcgtgtgtgtgtgtgtgtgtgtgtgtgtccttgcctgctagtgtgtgtgtccctgtgtgtctggaggtttcggtgttgcacactgggtatatcatggtgaccaactggccatgagtacgttagatctgttaattgtggaagcccctggtgttgggtgcctacccaccagtctcatgtgtgagtgtatctgtataagtgtgtgtatgtgtgtgtactcacgtgtggctctccctctgccactgagtttctgtgaccaggcccacctggtcactaagggaggggactgatccctggggtttcctcgttcctgctgtggagtgagctggggcttggtgagcaggccagcagagggaggctgtatggtgcatgtgtgatatgtgtggttgtgtgtgtgcgtgtgtgtgtgacagagaggtgtggtggtgtctgggcagctgtacctggctgatgggtggtgtgagggctatgcgatgggacagtgctggggtaagcctgggagtgtgtggccacggtaggagtgtgtgactggtgggacacagtctatgaaactgccggtgtatgcttggggagtgactgtgattgtggggaaccgagagtgcctgggcgtgggtgttagcggcaggagggggtgtgacaaggtgtgtggtgacagtgctgggagggaaggtgagagcccagtgtgggggtgtgtgtgtgagtgtgtgggagaccatgaggatgtgggtgtgcacatggagagggctagagggcaagtcttggggtttgtagtgttgtgaccaagacctcgggctctgtacccaagaattatttgggctccaatacttgcttgtgcctgttaagagcaagagacccaagctaggcctctcaaggctgagtgtccttatctgcagaatggagagagtgaggacaaaagttcctgtgttaaaggtcctttaacacaatcttggcc

SEQ ID NO: 35 - DNA, 8467 bp, Homo Sapiens
atgaatcaaacctttctctggcaccaagaagggacatacagtattccgagctctgcccttgttttcttatcaagttttctctaacagctggaagtggttgaagggggctgtcttaaggagaccccctgctcttcttttgacagctgatcaaaagaaaataggtcacgcttctcaaacttatgtccaccctgtccttaattactgtctctttaaacaaaggcaacatctgcgcaacctcagctagcttgaatcttcggaggcaaacagagcgcaacctgctttggaagaatcttgttacgtttaaggctttatgccgggtgttggcctctctgtcttcaactacccctccaccccgactcggactgcagaaatctccaactctctgtcccccagttccactcccacctccagacctggggttgccaaacaacggaaattctaggaagacgtaggtgcggtttttaaagccttggcttgtgagcgttctcaggctggccggggcgctggtcttttcagaaacaaggtttgaatatgcaggtgtcagccaggattccttgtcgtctgcccaccgccgtttctctcccgggatttgagagaagcgggagtgtgtgtgtgtgtgtgtgtgtgtgtgtgtgcgcgtgtgtgtgtctcgtgttaggagaaaggtccgtggttgccgtctcagctggtttgcttactctctgcccccaggagaagtttgctcacttgggacaccagcgaccctcctcacctccacctcaccggttctacactctccccacttctttccaagtcgctgatgcagaaagcacttggtcaccttgaaacggcagctcccggaattctagttttgttttgcaatctagcagggctcttcggaagcctcataactgagatttatgggctcaccgggtaattaaatgatgttattgtgttaactttgcatgcattactgctgcccgcgccgcccgtgggccgccggccggccgcagctcgctggcgacgagggcactacagttgctctgaccgcgtagattatgcatgtcccggcctcgggaatttaccatgcattagaatacattagcgcctgcattttaaaaggctaaactattggctcccagctagggactctcggtaagtggcttgttagtgacgagtgtttgtctatactggcacatagcggagtcttttgctcccggcttactcgcctccaggaaagctttggggtgaggcgaaggcgattgaagcaatgccccttcccccagatcgcagctgctcaggggggacacagcacggcatctttcaccgaatctctctcgctcgctcgcactccagcctccctctccccagcgacccccccaccttctcctccctccctctccttgacgtttgattccagtagcaaaggaggtaaaaaaggcaccgagccgtcagccaaacctgaaaagtgcggccccgccccctccacagccactggtagcttcccgtggaaggcccgcctcccggggcagctgcggcctcggagtggttgcgcttggcgcccgtcgggcgtggccccgccccaggtccgggagggtaggttggctgccccggcgagcggcagagcccttctggacagctcccgctcacccaaacagaagacgtcggcgccggagcgggctcggacatggcgaggctgcgagccggcccgagcggcggggcccggtgatccctccctccctccccgtcccctcccctctcccgcacgcacgccccgtccgcccccaccccgcccccaccccgggcgagcccgcccgcagcccggggcgcacacccgcacgcgcactcctctccactcactcccgcgcccgcccccactcccgcagccgagccccgccacgcgcgccttgcccgcccgccggccgcccccgccgcccccgccgcccccgggccctgatggactgaatgaaggctgcctacaccgcctatcgatgcctcaccaaagacctagaaggctgcgccatgaacccggagctgacaatggaaagtctgggcactttgcacgggccggccggcggcggcagtggcgggggcggcggcgggggcggcgggggcggcggcgggggcccgggccatgagcaggagctgctggccagccccagcccccaccacgcgggccgcggcgccgctggctcgctgcggggccctccgccgcctccaaccgcgcaccaggagctgggcacggcggcagcggcggcagcggcggcgtcgcgctcggccatggtcaccagcatggcctcgatcctggacggcggcgactaccggcccgagctctccatcccgctgcaccacgccatgagcatgtcctgcgactcgtctccgcctggcatgggcatgagcaacacctacaccacgctgacaccgctccagccgctgccacccatctccaccgtgtctgacaagttccaccaccctcacccgcaccaccatccgcaccaccaccaccaccaccaccaccagcgcctgtccggcaacgtcagcggcagcttcaccctcatgcgcgacgagcgcgggctcccggccatgaacaacctctacagtccctacaaggagatgcccggcatgagccagagcctgtccccgctggccgccacgccgctgggcaacgggctaggcggcctccacaacgcgcagcagagtctgcccaactacggtccgccgggccacgacaaaatgctcagccccaacttcgacgcgcaccacactgccatgctgacccgcggtgagcaacacctgtcccgcggcctgggcaccccacctgcggccatgatgtcgcacctgaacggcctgcaccacccgggccacactcagtctcacgggccggtgctggcacccagtcgcgagcggccaccctcgtcctcatcgggctcgcaggtggccacgtcgggccagctggaagaaatcaacaccaaagaggtggcccagcgcatcacagcggagctgaagcgctacagtatcccccaggcgatctttgcgcagagggtgctgtgccggtctcaggggactctctccgacctgctccggaatccaaaaccgtggagtaaactcaaatctggcagggagaccttccgcaggatgtggaagtggcttcaggagcccgagttccagcgcatgtccgccttacgcctggcaggtaaggccggggctagccaggggccaggctgctgggaagagggctccgggtccggtgcttgtggcccaagtctgcgcgccgagtcacttctcttgattctttccttctctttcctatacacgtcctctttcttctcgtttttatttcttcttccattttctctttctcttccgctcttcccctactttcccttctcccttttctttttctttcttactctctccttgtccctgagctttcattgaccgacccccccccatttcattcgccctcccctcaatgtgccaacctttgccctatttccgatcttcccaggtactgggaggcgggatgggggtgtgcgttttcctctaggagccctgtctttccaagacccacagaaaccaggacctgcccttattcaaaaccccatgcacttcaagtctcttttagacaacacatttcaattttccgggctgactagtctccctgtgcagaggcagttgagaggctttgctctgcagagggaaaagagctctctactctcccacccaccatataggcaaacttatttggtcattggctgaaggcacagccttgcccccgcggggaaccggcggccaggatacaacagcgctcctggagcccatctctggccttggcgttggcgcagggactttctgaccgggcttgaggggctcgggccagctccaatgtcactacctacagcgagggcagggtgtaaggttgagaaggtcacattcaccgctttgggaggacgtgggagaagagactgaggtggaaagcgctttgccttgctcaccggccgtccttgccccggtcccagcgtttgctgggatttgccaggatttgccggggctccgggagaccctgagcactcgcaggaagaggtgctgagaaattaaaaattcaggttagttaatgcatccctgccgccggctgcaggctccgcctttgcattaagcgggcgctgattgtgcgcgcctggcgaccgcggggaggactggcggcccgcgggaggggacgggtagaggcgcgggttacattgttctggagccggctcggctctttgtgcctcctctagcggccaagctgcgaggtacagccctctattgttctaggagcacagaaacctcctgtgtgggcggcgggtgcgcgagctagagggaaagatgcagtagttactgcgactggcacgcagttgcgcgcttttgtgcgcacggaccccgcgcggtgtgcgtggcgactgcgctgcccctaggagcaagccacgggcccagaggggcaaaatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccagcttgtggggtgcactcgaccaacgcccgacagggctggggaatgtgacaggcagcaggttcacccgggcttggggagggggagtttccgctttgacagcattttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaagcagccagtagagagcgataataatagcggcgggaaatgaactggagactggctgacagttcttaacattttgtcatagatccccccgaatgtcccaggctgtctctggtgggttttagtacccgccggcttcttgggcaccggggaccagaaggaacttggcagctggtcttaggggtacagttaaaggcaggatgacagctattctcctgctcatctcagagcgctgccgccccctcatgccggtcgcgcaaagaacacagcttttaaaaaacacgtgccttctgcccatataggtctgaaagtgatgaggaaagtaatgcttcgcctattagcgagtttcagcttttaaaatgatcccaagcgttgctgagatgagaaagcgtggcatcccgggggtcctcagccccacccgcgcccatggtgcaagtctgcagggacaggcccgggacagcactgcccacgctgctagattttccgcagaggatcgctgaagctgccttcgtgggagacagaatgcctcctccagcgagtggaaaaggcctgctgaggaccccgctttgctcgagcattcaaatgtgtgtctgttttattaccctgggttgaaaagggacaagagctttagcctttttatctggccattttatcagcaactacaagtgtgttgagtggttattattacataggaggcttttcagtttggggtcagtagatcagtctcttcagacactgatgcagaagctgggactggtaagtaggtattatgtgctcggagcgctaggggacaggagcaaatggagaagaaaagcggaggctttctccgcccggagtatcgatcggaatccccgccggtacgccgcagagggccctcgccgttgggccccgggggtttaacaagcccagccgctccgcaggcggctcggccggactctcagaccggtgcctggaagacaccgtccctgcccccctcccgccaaacctgcctcttctctttctctcataggttataggttccctttctctctcattttggccccgcccccgggtcctgccaaacagccaagcaggccggggtttagggggctcagaatgaagaggtctgatttggccagcgccggcaaagctcacccttaggcgaggtcacaacagaggcaggtccttcctgcccagcctgccggtgtagtcacagccaagggtggcacttgaaaggaaaagggagaaaacttcggagaaatttagattgccccaacgttagatttcagagaaattgactccaaatgcacggattcgttcggaaagggcggctaagtggcaggtggttgcaaccccgcccggtcgggccttcgcagaggttccccaagaccagcccttgcagggcggttttcagcaacctgacaagaggcggccaagacaaatttctgcgggttcgagcacacactctcgggcgttgggccccagagacctctaaaccaagcacaaacaagaagggagtgagagaacccaggctagaacttgcacgggcatcccactgaggaaaagcgaggcctcggtggcaggcatgttttcttccgacgcccgaaaatcgagccgagcgcccgactacatttactgcagaggtttccgcctccagtgagcccggatcccccagcggcctgcccggagctggtctccagtccccgccgtagtccgacgcacggccctctcctggcagcaagctcccagcggccagtctgaagccaattctgttcaggcggccgagggcccttagccaacccaccatgatgtcgcctgggccacctgatgcccgcagcggcgggacacggcccgggcagtgcgcagtggctcctgctaggggcaccgcgtgcgtgcttgtctcccgctgcgccggggacgtccttgggtgacacgggccgctgggcacctcccaagccgaggaaacggacccccttcgcagagtctcgcgcccaccccccaacctcccacctcgtttctcgctgctagggctcccgactcagcccacctctcctggcggtttagttagggatcagagctggagaggctgaacgcaacccgtgccagtacggaacagacgatatgtttgcctgctagctgcttggatgaataattgaaaagttcgctgcagtctgtgcttcgtcaagtcccgggtgccgggagaacaccttcccaacacgcatcagggtgggcgggagcgggcagaggaggcgggacccgagggaggagagtgaacccgagcaggagaagcagcccaggcagccaggcgccctcgatgcgagaggctgggcatttatttttattccaggctttccactgtgtggttatgtcactttctcaaacaaatgtgtatatggagggagatcgatgctgataatgtttagaagattaaaagagcattaatgctggcaacaataacgtaaacgtgtggacccagatttcattgatctggaacttgatccggcgcgtttccagtaagcccgacggcgcgctcttcccagcagagcgctcaccagcgccacggccccgcggttttccagcggtgccgcttcgccagctctgcgcgggttctcccgtctgaccgcagctcctcccccgcgaggccccagcccgccttacttccccgaggttttctcctcctctcgcggggctctctgccctctgcaccccctcccccgacctctgcaccacccgcccctgtgcgcacacaccgctacttgcgcttccggcgatccgcctgggcggctgggtccgcgaagccaatgcgctgaacggtgcccgagtcttcctaactatcctgtgcttggccgttgccactgggccctggtgactaagcccaagtttgaaaatgacgtggctaaagctgcctgctaacggcagagcttaatcagccgcagatcccctcctatcctcatcggttctcgtactaaaaaggctcacgcgcagactttttacgcaggtgcattcgttggacaattaaacgtggccctagtaacaaaagcctgagcttcatccctccgagtagcaggctctgcgctggactggtcgggtctaacagggagaatcttgtgtcctaccttggctgggacaggaagtaagagaagcaaactggggaacccctgccccaccccttcccaccccctggacgtcctgggccgaggcccgggtcactggcccatcgcgggtaaggaggtgtcctgtggaacacctgcattgactggaaaagaaagaactttaaagctcttccttcccgcttgtgggggacaccaccacaccctgccaaccactcccctggccaaatggtggcttgtttttccagaaggagcactaaggtgaattttatggaaaaaaaataaaagatcagggacctaagtgggagtaggatgagaactaattctt

SEQ ID NO: 36 - DNA, 6456 bp, Homo Sapiens
taaaacccttcaaaactgaaaagaagaaaggggcaattggagaattcccactttttctggctgtctccttcaagtcgcccagtttttatgaacagcatctagccttactgtcactatcaacaacccttaaaactagccaatgcttcggcctctagtattggaaagtcttccaaataggatactggaaacttctatttataagcttggggtggcgggcggggcggggaggtggagagagagttgccatctacaggtttctattttggcctgaagactcaactgcagtcattagagtaagggaatgcccatctcctggtacttgttcgccatttcctcctcccccagagacaaatatcttttcgtcttttttaaaaaagtatatattttaaagcaagaatgtgatttcatctctcttctttgagctcatgtttgctacctccaggaatagcgtgtggactagggccagatgaacttcaacttgggctgcagatttacgaggttctgttctagtgccaaaggctcttggtagtaaatagtgagcaaaatagatacctgtctcctgatggatcttgccgccccctctttttttttttaagttatttattaaaaccacacacaccttgcaaagaaaaagggaaactggcagtctctgtagaggaagccggtggcatcgctcagagccacaaactgtatttctaaacagccctttccctggttccctctctcctgccccactttttttaaaatccagactgtaaaaaacacatctactgacactcactttactttaaaaaaagaagagaaaaagtaaagcgttacaagactttcctcctggaaactataaactgaaaaaaaaatccataaaagattaaatcctggcgggttgtggggtggcgggggccggcggggagggggcgcggagtggagattggctctctgaggtggtcaggggccctgtgacagcttgggactttcagcacctggtttggggtcatttatctgctcaactgtcaggaccccccacccccaaaccccagccaccaacacaaccatcgtagaagggaacacaacacagagggtcttttttcatttttttaaaaaatcggtttggttgtgtttttgttttccatgggggagctttaaaactcattattgcaacactagttccatttttcgccagggttccaataacacggcatcataaaggcaacgcaacccacagttctcaagacatttaccacggtcactacatccggcagcggggtggcccctagctcctgctgcccccccgccctttctccccgcccgcccccggagctcagccgatttctgaggctccaactctacccactccctccccgggccgccgccgccgcgccttcccccattcttactccctcgaggagagccacaggttgcaaatccaaccaacctcgcaatctatttttgcaaaatcactcacaaagatctccctttcgcgcccgcgcccgctcctcccgcgccgggtcccctcagccacggccacaaagtgcccttctctcctcctgagtcttgcacataaggaacgcgggctggggctctgttcgtctttctcctcgcccaaggtaaggacctcgggaatctgaagcctggcgtccactacgctcaggcccgcagttccctttttacagagcttgcaccatgggaaaaaataaaataaaatttaggaaagggaggcaacagccattgggagccaacacagagtcacgcagcgcccaaaatacaaacaccgcagcggccagaaatcccgccacctttctcgttctcccaggctgtcctgtcgaggttccctgagtccccccgcacactgaaaggcatcgcaggtgcagtgcgcacccctttcccacccaccccaagaagccctgtcccgccatcagtctctctcctcgggatgagcagggagagcgcgcggaggttcccgactccctcgactacaaccaagaaagaataattttcaaagtgttcaacatccccgcccccaagctccccaaaacacaggggcagggaacaccaaaacactcggctctcattaggaagatcacggctctgaaaggaaatagtagacacgatacttcatctcatctggatttatgaccaaaaaaacaaaaacaaaaacccaaagagttcgcttgcattttttccttccaaatctcggttcggctcgaaggcagggaatctaaaagaccgaggccgatggaagagagccagcggggcgagcgagcgggcagcctccctttttgcctcccggagttacccagaaggacaggggaagggaaggaagaagaggcgaggaaaaagaggagggagggaagcggaggccaggagcgacggagcaaggaaagcagtttgcaagcgagaaaagagggaaaaaacacagccgcacgaatccagagagatcacaagccgtacgcaagcagcagcagaaagagcgagagcgcgagcgcgcgtcctctccgcggtctggggccagacagcccccagactagcccgaatcaccccccaagcactgtctcgtcctctctgctccggccgccccctaattcccctccttcctctcctccacctcctttccaaaaaccaaaacaacacaagggagggtggcaaaagcctccccaaaccggccgattcactcaaagacaacaataataataataaatacataacaatctatatcctatggtgggagagacgtgggactaatcttcggcatttattttaacacctgacagctagaataaataaatatatacatttatatcaatagatacacatagaaaacttggagccaaagcatttggcaagagcggaaaaaaaaagaattaaaaggtaaaataatgatcatgagcagcggcggcggcagcggcaccagcggcaacagcggcggcggcggcagtagcagcagcagcggcggcagcaacagcaataatcacctggtgtccggcctttcctagaaacttcttgcatcaccacttctaagaaccccagttctaagaatcaacagagctcaattctcggaatttgagcttcggactttaccactgctacgtggcaggggaggacttggtgtcagctctccgagatttttactgcccctggccaaccaaaagccctcaaagccacaagattttttcactggccggcatatttcgaggtcctcataagcagagcgtctcggatttggaggttccggttcgaggctcgaggggcctgaaggtggctctccctccccgggcccaagacgatggtatggcctgctccgccaccatcacgtgggctcctcctctgtgacgtcggcgccttcgctgtagcaaagctcggcctctggaattctgagaactaatttgctattcggtgacataagagggggagtgcgctttgctttcccggggtctggggctaattccttctttcttacccataaactcagcagatcgagctaaatgcacaaaagggagcgagaggtttgaaccactgggaaaagtatgttatatatatagtagggttagagaggcgagtaagagaaaaataaaataaaataaacatcacagctctttccaactagaatattaggcaccacgagaaaaatatttgccaagcagttttcggtgggttcatttgctttatttttatttaggacaggggtttttgctgttgttctgggtttttttctttctggtgtggtggcttgggatttttggtttctgtattttgatggtttatggatttttgcttctgattttttgccttttgcaagtttgtggtgttacgtaaatcacaggatcggcatcggttggatttttttgtacgtgccttttctttccctatctaatccctcaagcgttttaaagatgtattatttcaatactaatactattgaaagaagcttaaatttttggccatatgtaacaatcccagcccccactttttttttttttttttcctttggtgcaattttctttttcccccttggacttttgctgaagtgtgtctctcctgcacttcagagaaatgttcaaaggatttgttttggtttggtttgtttctttccaggacagcaagtggtgggtttaatctgttattgttgactcttgggaaatttcttgttgcaagaaacgtgtgtgtgggggggagggtgggggtggcggggtggtatgtgtgtgttttctacaaaattctgtgagccaaatacctgtttgtgttttgttttctcttaaggtcttgagatttttgttttcgaggctcgtttcaaggtcgttgtaaaaaaatctcttcagtctgtgtttaagagatcagccggagggaattctaaaggcctgccgtgccagtatcacagatactgcctgtatttagaacagactgccacaactacaatgcactacacgcagcacagtcttcttagctttgaagctgagttggggggtggggtggggggggggtagagaagaaggagaaattctttccttctctttttctctattactttctttttaaaggcaattgcagtgcagaatcatttcattgtgggtcctagtttgtttgttcagagctgctagtttccttatttaaatgttggttcgggttttttcccctcctactcatccctgaataagggagactcttgtttcttttatgtctctctcttaaaagaagggtgtgaggggaaaataatatttcagattcctcaagaattagcccaaaatgtttggaccagaagcagctttcaaaggtcaggctgttctgagccttggctatgagagtccttcaagcgacttattaaattacagatgaattcttaaagcttccacaaaatctcgtcacttgttaatttctaataaagatatgtctaaaataatctacctatctcaacccaaaatttgggtttataatggaggagtgatcagagctgtgaaagattgctgtttgctgggatatttggaaaatctctttcattgacagtcccgtaagaagttccatctatcaccgaaaatgttgttggcaatgcacccccctaccccacaacacacacacatttttaaaggctgtattttaggttttaaaacccagaaaggtgcaaagaggttgattattttccacaagggctggagcttaggaaatatgcgttaaagtgtctgtccctgtgaaatctgaatattttaatacttattgacagatggattactgcagcctctgcagaaaagcctgtcttgtgaacggtttttgaaaaatatacataggcctaatcctgtcactgttgttgaaatgtacgttttacccccaaagacacatgatattgtcaagttcagatttattctgccagaaggcagactatctgctttttcatttgagtccccttccttctcattttcaaagaaattaaaatgaatcccgctggatgcaaaatgacaccccgattttgtggaagggattttctttgtgtgtttatatgtgtaattttttcttttatgagcaattagcactttaggatttctcagacgtatctatatggtttggaatgtgaattgtatggctctgccttactattgggccctcaaaagattatttttatgatttttggtcacttttttctttgtcaaaactgccattcagcctcatccaccgcccccctcaacctgaaacacagcttgtccctcctgtgttccctttgccactccactcttagccccatgggggcgctgcagagcaaagggaaatctgctctctaaggcagtagtagaaccagccagagtgggggctgggaaggaattcacccttctcatacctcagccctctttaattctctgcagtgagcccctagagggagaacccaccagggctggttcatatataattaacctcatcaccagggacctcaaatcttcccagcatattatttctgggaccaagtgccagagtgccacattttcctactgctttttgccaaatcaatgtgtttacactgaaagaaattgaccagaacagaagaccagttagaaagaaagagaaaatcattattgaaaattttctaaagataggcacttacttttcggtgagtctcttttactttgaactgaatgaatggtgaggaaaattgtgcacccgcctctcaatctcttttcaattcctaggaaagtaactttgtcaaatattataccagttgaatttcttccagaatgtcatttcttctttcattcttgacctctcctcagtatccagttggcatcactatgtgggcctccctcactcccgcagtgccgtgttacaggattaaagaaagggctgacttgaacgtattctgattcttttaaatcatccttaagaagctctaaagagtgattccatgtctggggtcgtatgaataattcctgcagacttcggggcactacatttcaactagtcccatgatttaatggttactgg

SEQ ID NO: 37 - DNA, 4001 bp, Homo Sapiens
tgtatttcttcctttttctagtccctaccaatctctgaaaaaaaattcctttaattagaaattctgtgagactgttctttccttagttttgactttaatgtccaagaaagatggcatcacctttcttgaccatgaaaatttagatctctatcattcttcagaaatgtgatgagtgtgaagaccactttgaatatcctcaagtcatcagtttagcttttttcttatggatcacagcactgactttgtcaactgataaaaacaactagaaaatgctttaacgatatggcacaaaccatgaacatcagaattcattagtccttcttctataacctccctttattaacatgtaattgtaaaagaagaataagaagggaatgggggtaatggatctaggctcaaaacacatacctcacctttgcctctctccatggtttttcttggcatgtatgctgtacattctcaatacttctaagacactaaaaactcattaatttaagcatatttaattcagattcagttctagttcagatataatgcttgactctcaagagttcaaaacacaactaaaaatgcaaatatttgaaattagtgctatactgagagctccccaaaacttaaatattaagacacatatttttcttactaagacctgactcccaatatatatttcttaaggtaattaaagggaatacttatttttgtttgaggaaaaaatattttgtaagctaaaacttttattaacacagtaccctattacatgacttcttcctcttattccaaaataatggggcttaattttttgaagcgcagtctttccagtaataaaggcggacaaatttgcttccttttgcaagtagacactttttaaaggtaagaaagggaagattttgtcagcccagtttattacagttaatgtctctttcaccaagtgtccaactgccccgaaagccagatgtttcagaaagccagatgtttcacagctgttctggtggcaattacttcaagacagcggtatcaaaggctctgatttttagcttcctcatctaaaaaatggggacatcaattactttataacaaagctctgatgatacaatgagattacaaataaaatatcctgtgatgtttgactcactacttaactaaaatctttataatggatccatattcctggcctagctaccatacaccctgtcaagtggtttccttctaagaaaaactggggatgggggggttaggggggtgggagagcagcagggagtaggaggtagggaaggaggaaaacaagcaaaatcagtacatatacaagctctcccatctttgattgcctgcgttttttgtgctttcctttctcaagtttcctcaggctcatgttctgaatctcctcccccacaaatgaaacacaacggatacgaattacagagaattttacggaagacactggagcttaagtctgcagattagttttttgtctacaagcggaggcgactggaaaatcaagccaaataagcgttggataactctaaacagccaaagaagcttcaatgggatagggtccaggttcaccaaaggaggcaacaccagcaactgacgaaaccatagcgacggctgaccgaccatgactcgaggtacaagacgtcaaacctaaggctactaatcaacgtgcgtaagaagcggccccaaccgacccgggcgatgccaaccgcgcaaccactggtcgccgcgccaccccaggcccaggaatagcccagtccgcaacagggagacctcaaccagggagaggaggagcggggcaaaggggctgggtgtcccccaagccgctgcgcgggacgtggaagggacgaaagaggtgaggaagagtagtaaatcaattcaatacactcacacttctgctgtgctcccaggactacgagaagcgggtagggggcgactcccggcctctttcacttcgtaaaggccttcaactgggtctctcggtcaacccctcagctaccgccatcttgaaacctcgcgcccctccgcactcctcacgtcatttcccattcctctgtcccgccttctcttagcgccgcttgaccctggaaccatagagaatacccaagaattccaggaccagagtctcttccggttccatacaatactcaattggttggttgtcggctaagagcccgcctcattgcgctcatctagtacaataggaattagaagaagatagctgctaactgagtggctgacggtcctgtctctcgagttggaggcatcttgacttagttgctgggagcctggtacgttgagccgtccgagaacggtacattctgcagataaagaagcgttctgcgttttctgtcttttggaattaccttagtttttgcatttttctgtttcttatgacccaagcaggtgcgatcctttaggggtgtctccgtgtgtaaacgaatacccagataacatttgccactgagtttaatccgctttgtaagcatcaggttatcccatgtgagcgcctagtacgtgtggaaatttaatagacaggcagaacagaacgtttgtagaccacctgaacaaataaattagcacccgtattagagtcgcagattgcttatatgggcggtgatttattatttgttagtagtgttttgaagaagaaatacggggatacatatgcagtcggttttaagttatatgagtggcaaggttgatatatattggctatattcccgactggtcttttcaccagccaaaagtcctctatgatgtcactctacgtacgggattcttcacttaactctagccttcgccctttccctaccttctatcccctctttccgtgagtcagcccccacttatttcccttaaaggtaagtttaaacatttaaaaaactatcttagaggatacgcttggttatttctaatcttaacctgactatcccatgtaggaaggctattcttaccaccagttataaatatttcaaaatattgatggagatacatactaatttttagcagaatctttaaactgcccttgaaggtataagatcggtcctatacctaaacttacctttgtgttaggaaattcttgatttgattttagactgaatttgagtgtcagaaagcaatgacgagatattgtaggttaaagctgataaaccaggtagtacataaaaaagaaaataatcttgaactgcgaaggtgagctaagttgtaatgttttgcaactagttttttttctttcctaacacattagtgatcatagttttgcaactcgttttgaaaaacaatgcaagaagagaaagagaaaacagtgtatgttggaaatattaaagtctttcatgtagctaaaattttatatgtagctactatttttaagatatgctgagcagtttttatttcaatacatttcttgtacttggatgggagaatcaactataacaaacacagtctggcatcaacagcatattaataattttgtcagtatagactaaaagagtcctcatgggaattattggttggcaaaggatttagaaaacaaacacatctgcagagattcagcggaaccattaataggcttccatagcctttggcgttttctaaaatcaggtaattagtgaaatggcccacctaatgcgtcatgtagcaaaggcagctgcctcctttttgctagtgttgaaaatgaaattatattcttttttctgaaagcttataataaattatgactttcttttaaatgacaaatgctttgagtagtgaccttctattctgcatcctaaatgcaatatgtgtagctgtgttttgctttcttgtcttctaaatgtttcagtgtttgaacattcacttgagcgatatttaattatcacagttggtcagggttgattgcagtgactgaaacaggaccttgatgtttttagttttgatttttaccattttcaaatccatccggtttacattgtgtaatcagtagacgtttacagatcagcttcctgtcctaattgaagcacattgttaca

SEQ ID NO: 38 - DNA, 4341 bp, Homo Sapiens
tcatggaagtctttagcgggggcttgtaagggactgtgagctgagctaaggagaatggaggtggggtgccaaccgctcccaaagggaaatgccatctcccactcacagccagttagccgagaatgggagctcccaaagggaggaccacccatgggtctgcttgactcagccctccccaacccctttcacctttgcagtaaaactctagccaaggaagacaaagagacctttggagaccaaaacagaacttttaattcgggccaacagcaggctcatgcccaaaatggctgccaaccccaacaaagaaagcagctagcttatatgtcgtttgagatgggaaaaacaaggtaggatacaggtttcagacaaagacagtaaattacttaacccgtgacaattctgaggaaactggcaattcagttatattgactagtcatcctccaagctggactagggttggaggctggggtcccgaggcaggtgataagcttttgagataagcttgcatctgcaacttgttacaatgctgggaggggctgcttaaaattttagcctatgtgttacttctaaatagcttatactaaatgttaactgttttcatgtgcgtccatgtgaagagaccaccaaacaggctttgtgtgagcaacatggctgtgtatttcacctgggtgcaggcgggctgagtccgaaaagagagtcagcgaagggagataggggtggggccgttttataggatttgggaaggtaatggaaaattacagtcaaagggggttgttctctggtgggcaggggtgaatctcacaaagtacattctcaagggtggggagaattacaaataaccttcttaagggtggggaagattacaaagtacattgatcagttagggtggggcaggaacaaatcacaatggtggaatgtcatcagttaaggctgtttttacttcttttgtggatcttcagttactttaggccatctggatgtatacctgcaagtcacaggggatgcgatggcctggcctgggatgcgatggcctggcctgacaactattacctatgttatgtttattattttaagctttattattactattttatttattttattttattttccttccacacacccgtttccaccctggagaggccagatgagccagactccagggaggcctagaagtgggcaaggggaaacgggaaaggaggaagatggtatgggtgtgcctggttaggggtgggagtgctggacggagttcgggacaagaggggctctgcagccattggcacacaatgcctgggagtccctgctggtgctgggatcatcccagtgagccctgggagggaactgaagacccccaattaccaatgcatctgttttcaaaaccgacggggggaaggacatgcctaggttcaaggatacgtgcaggcttggatgactccgggccattagggagcctccggagcaccttgatcctcagacgggcctgatgaaacgagcatctgattcagcaggcctgggttcgggcccgagaacctgcgtctcccgcgagttcccgcgaggcaagtgctgcaggtgcggggccaggagctaggtttcgtttctgcgcccggagccgccctcagcacagggtctgtgagtttcatttcttcgcggcgcggggcggggctgggcgcggggtgaaagaggcgaagcgagagcggaggccgcactccagcactgcgcagggaccggtgagtgtcgcttctgggggcagcgcccagtaaccgcgctaggagcgcggagaagggcattgggagagcggcgttcgtggcggagactagcgctccggagcacgggcacgacgggggcaccttctcggctgctagtaactaacaataataataatcataatcatagcaagggcgctgatgggcgggctcggagcacgcctgattctggttcccaccaggctgcccaggctcctgatgacgcatcagaaacatccccctaacccgcggccttcctgcaggagaggttgggaaggggtgggggacggggctcgggggaggtctccgagggactctagtaagcggggaagggcgccgggaaagtttcagatccacggctgcgcgggccacgagcccacccgaacgccgaccactgctttccgtcgacttctatttcctgggaacgcgcgaaagcaaacccaagtcagactgcggaggtcgctggggagggaaggttcaaggagttctcgccgatcctgctgaataaagggggttccgagctgggccgagatggggcatgcgcgggaagacccctgcccgctgttcccccccaccgccccagtggatgccatgcctggggcctccccggcgcgtggggctgacgcaccctcggggtccatcgtagttggccgggatcgtggagtgggtgcggtggacgaagggaggcaggacagtcccgggggtggcagaaggagcccgggcacagctgagacctgcgctcccatcccaccaacactcacagcaggtgctgccgagctgggcaattgggatggcccaagttatttggttaaattttaaatcacgtttgttactgggaagtagagtccagtgatgctaaccgcgcctctacctccaccaccggtgtcagtcccaaagggctcctaaaatggctgtgtcatctttcagccttggaccgcagttgccggccaggaatcccagtgtcacggtggacacgcctccctcgcgcccttgccgcccacctgctcacccagctcaggggctttggtaggtagcagtgcatttggtctaaagggcaagatgttctctcttttattcataacaaatttaaataccagcagggtttggggggaaaaacgctttcagaagaaaaggtgaatgtcagtcctgcaagagttagttttaaaactagactgaattggcacatgtatacctatgtaacaaacctgcacgttctgcacatgtaccccagaacttaaaagcttataaaaaaagaaaaaactagactggattatgttgggaaagtgtagcctcttccatcttaggcatttcctagaacgtaggcagtaggtggtccttattaggagttttgggagaggaagggggctgaatcctacctcccatccctgctcctctatggggtctgagctgaggaagcttcaccacaaggagagaaccccctgacaaccctggatgccacctttaccctcactgcaggaattctgtggccacactgcgaggagatcggttctgggtcggaggctacaggaagactcccactccctgaaatctggagtgaagaacgccgccatccagccaccattccaaggtaaggcagaaatgaagtgggccgttgggttctttcttttctttctttcttttttttgagacaaggtctcactctgtcgcccaggctggagtgcagtggcgccatctcagctcactgcaacccccgcctcccaggttcaagcgattctggtgcctcagtctcctgagtagctgggattacaggcacacatcaccacacctggctaatttgtatgtgtttagtagagacagcatttcaccatattggccaggctggtttcaaactcctggcctcaaatgatccacccgccttggcttcccaaagtactgggattacaggcacgagccactgcacccagtcaggttcattttagttgttatgttaaccaggtttcctgcacctgtgcgctaactttcactttcccaaaaggtttcagggtgacccagcaggcaatgagtgattctcaaattcaggatttattgtgagagattcacacacacaattgagcagacattcacagtacaatgattaaagggagtgatagggtaaggacccacagtggaggctctggaggccagcccactgacagccactccagggagtccagaagtcccgctctagtgctgggtggtggagggaaatctgttcctccagggacctcgtcctcggctgcccagctgccaaagtcaggaataagctttcagaaatctcactgccaagattccgaaaacgcttcagacattgctagtcccttgtcgcttttgcgatcctccacaggtgtgcgtgccactgggtccttattcactggggtctctggtggcattgggccacagcaagtgttccctcatccccttagtctaccacacacatgcttaccactttgaagaaaaacccctttactatgagcgaaagtgagaaacacgtatgtttattgtttctaaagaaagaaacttaatatgggcttaatgctacctagtgagtgcctccattttgagacattagggtcacaagtcattattatatatcatgggc

SEQ ID NO: 39 - DNA, 4433 bp, Homo Sapiens
ggcagaaccggtgtccacagccctcggggctcaacctcatcaggcaggaggagctgagctggccctgcaaccgaagtctaaggtcagtgatggcagcgaggggcagagcccagggcaggggaaaccagagcccccaggacgcggccagcagagccctgtccctgctgcagcgccgggcgggggcctggccgccatggcccggcttccactcaagacggctgtcgaggaggcccgcagagaggcattaggacagcaacggggcagtgccacccccgcggccccccgagcggaaggaaaggagcctcccaggccaggcactgccctcctgggcaggagcgaagcaggggggatgtccgcccccctcctgatccacttcactcctcggagccctggcagcgaagcggaggcggagacaggtggtgtcagggcgtcctctcgccaggccgcaggccccgcggggcaacaggacactggcccctggcaggcgggcgcggggccctcgggctcgatggggagaggccggggccggcggcggcggatggacgctggctcgggagacagagcccgccgcccccggaaactggacccgctccgcctgggcgccgcggggagcgtgtgggacgcggtggacggggccgccgccctggacgcccacgcgcgcggcctccccacaggacccccactcgcccaggagcccgcactcccggcgctgcccgctccccgcgccctgcagcctgggtctcagacggaaggctctggggccaagggtggctggagcagggaggcctcgggggtccctgcccccggaggaggctggccctgggtcagcagggaggtcccgggcacccggagctttggcccagccccagactccacgcgcccctggctagagagtccgcctcaaggtcgcccactctcgtcccaagggccgggtgccacaggggcctacgatgccggcgaggccggggctgacagctcccgagataacagtcctgccgctgacctggggcccacccggcccccggagcaagcaaagccggctgcagccggccacagccgcgcgccctcccggagccgtgagcctcgcccgcgctccgcctccccgcccgcagctcccggcccggggttcccacctgaagccctgactctcccctctccttcagactttttgcccctggaggttacccaggatccttccgtgggcgaaaatctcagagcggcgccagccccaagttcagcctcagcccaagtcttaacttcagctccagcctcagtcctagccccagccctggcttcatcccccagctcagcaccaacctcagccaccacctcaacctcatcccccacctcagccccagccccagctccaacctcagctccaacttcaaccccagccccagccccaagtccagctgcagccgcaactccagccccagccccagtcccagtcccaaccctcacacccccatccccagccctaaccccagtcccaaccccagccctaagcccagctccaactccagccctaaccccagccgcatccccagccctaaccccagtcccaaccccagccctaagcccagctccaactccagccccaaccccagccgcatcccctgccccagcccccacctcagccccaaccccaaccccagccgcatcccctgccccagctgacgggtcaaagcctcaggagagtgtggctctccccaggcgctaccaggaggggcaggtctcagccagctggggaaaccttattgccatggttcttagaagccaccccttccccaggcaagacaggccccaagggagtgtcccgagggcggttcccgggagccccgtgggtcccagcacttccacacactctgaggacagacacggcccctcttcttcagtggggacagtcatagggacaggtacagggggcctggttgaggctggaggtcagccacagccaagaagctccgagaccaacggatcgcccagcccagaccctcccccaggcctaagaggagagggaaccagggagaaaagtctagacccgctgccccaagccgcgatgcccaggggccccgcacagccccccgcgcagaggccgcctggccccgcggcctcctcctctgcgaggcgctcacagccggtaccccagctacggaaacgcagcaggtgcgaaatcgccccgagctcggagcaggaggtcaggccggccgcctcgggggaccctcaaggggaggcgccgggggaggggggcagccctgccggccgcagcggggcgctcacggaaaagcaggaggaggcccggaagctcatggtgtttctgcagaggcccgggggttggggggtggtggaggggccccggaagcccagctcccgggccctggagcccgccacggcggcagccctgcggcggcggctggacctgggcagttgcctggacgtgctggcctttgcccagcagcacggagagcccggcctggcgcaggagacctacgcgctgatgagcgacaacctgctgcgagtgctgggagacccgtgcctctaccgccggctgagcgcggccgaccgcgagcgcatcctcagcctgcggaccggccggggccgggcggtgctgggcgtcctcgtactgcccagcctctaccaggggggccgctcagggctccccaggggccctcgtggcgaggagcctcctgcggcggcccctgtgtccctgcctctacctgcgcacctgcatgtgttcaacccccgggagaacacctggcggcccctgacccaggtgcccgaggaggccccgcttcggggctgcggtctctgcaccatgcacaactacctgtttctggcggggggcatccgtggctccggtgccaaggccgtctgctccaacgaggtcttctgctacaaccctctgaccaacatctggagccaggttcggcccatgcagcaggcccgagcccagctcaagctggtggccctggacgggctgctctatgccatcggtggcgaatgcctgtacagcatggagtgctacgacccgcgaacagacgcctggaccccacgcgcgccactccccgcaggcaccttccctgtggcccacgaggctgtggcctgccgtggggacatctacgtcaccgggggtcacctcttctaccgcctgctcaggtacagccccgtgaaggatgcttgggacgagtgcccatacagtgccagccaccggcgttccagcgacatcgtggcactggggggcttcctgtaccgcttcgacctgctgcggggcgtgggcgccgccgtgatgcgctacaacacagtgaccggctcctggagcagggctgcctccctgcccctgcccgcccccgccccactgcactgcaccaccctgggcaacaccatttactgcctcaacccccaggtcactgccaccttcacggtctctggggggactgcccagttccaggccaaggagctgcagcccttccccttggggagcaccggggtcctcagtccattcatcctgactctgccccctgaggaccggctgcagacctcactctgagtggcaggcagagaaccaaagctgcttcgctgctctccagggagaccctcctgggatgggcctgagaggccggggctcagggaaggggctgggatcggaacttcctgctcttgtttctggacaactttccccttctgctttaaaggttgtcgattattttgaagcccagactccctcagcctctttctgcccctcactccacacccagactgtttcctgactcaattccgtacctacttacagaccctctcagcttgctgacacccccctgtctgtgggactccctattccctagagccagggactgatgcgtctccacagacaaggacttggctcgctggagctctgctgagccgagagaggagggggtagaaaacattcacacttcctatgctctgtcagcaggacagggagcaaaaacgtccccaggcaacgccctcgcctctgggactttctgcctgtcctaaggcctccccaggtaccaaccccgtagctatctgggtctgtttggcactgtggattctcaagggcctagaacccttgcctctgaaactggtccgctggtgcagccctgctgtctgcagctcctgcccatacccccagcccacaccaggccaggcccactccgggctcaccaccctctgcagccttgtggggctctcccagcccctccagaagcccaccccacttctcgccaacccccgatctctaaatgaggcctgagcgtcaccctagttctgcccctttttagctgtgtagacttggacgagacatttgacttccctttctccttgtctataaaatgtggacagtggacgtctgtcacccaagagagttgtgggagacaagatcacagctatgagcacctcgcacggtgtccaggatg

SEQ ID NO: 40 - DNA, 4494 bp, Homo Sapiens
actataaattagcactaccacaaaggtaagatgattgtgactaggttaaaccctcaacagagggaaataaaacttaagaggaagctagatttaaaaataaataaataaataaatattagggtagtgaaacatcatatagattagggtttgttaaactcacacctctatcaacataccagccaaaatcatcaacccagataataaccatgtttcccccgatagccaaggccccattatcattgcccttattcatttcttttctacagccacctgcagcagacctattttctaagctctataaaagacagtcaactcgtaattacatcttttcagtggacacagagagaaccagataaaccaccctcaaacctcagtagactgaattacctacccttctaccaacacttcgcaaaatggcataatgtgaatctcacctccaccctttaaaggagttaacaatagctactgaaaaggtcccaaaagatggcagaaagagcatattaatgcaattaaacagaccaaaaactaaattcgaatctgcctacatgcttcctctttttatacagaaagaaatattgctcaacaaagttacatatttaagttttgacaaaagcttcaaaaatacggttatcatatgcttttaattccttaaatgtatggtttttaatctgtagtaagaccattcgggaaaactggaataattctacaaataaatgtaagtaagtcatgagagaaatcagaattctcttagttaagtgcatttttttaaaacatggaaaacgaaattctttaactcttaaaacaacctgtcttaactagccctaaggtgattcctgagccacttgtgggtaaaaatcagaagagaaaaaagttcaatgaccttgcaaattagaaactaaaaaactaatggtgtgatagtctgtacagcctcagtggaattacaggaaaacatctgcccggaaattgctttttttcttttggaaaattactaggaggctgggggaaaagaggggaaaaacgggtaaggaaggttgcaaatgttaagatgccaaacaggaacccaaccgaagtccgaagtgaaatacagcctcctctggcccaactgtcatgcaaacaacttctaagcatcttcagatgtaaagaaaaacagtcattgtgcacaggcgttagctgaatgttcgagagttggatgaatggggaagacttgttatacacctagtggtgggtggatttcactaggctgcagcctccacacagcttttctttgctgcactgcagaggcgccatcttctccgtcttaatcttcactcaattcgatccttttatctgcaccctaaaaaaaagacccttcggaccctccccagcatcctgtgcccccaggggaactaaaccagagtccccagagctgccagggaagaggccgcgccttaatcagacaaacgcctccttggatgcacaggacagagcccgtgcctccccaccatccgccactgccctttccagacgcacatcccactctccgccttatttcctccccgccaaggactttacagcccagcacagaattaagcctcggaggtgatccgagggtgggaagcagaggggccccgaggctccgccagaagccccggcagcgtctctgccccctcccaggcggacgcgcagccccgggaagggagccgggcgggagcctcggtggcgcactgagactaacgcggctcggcccacggcgagggcggggtgtcgcggcttttgttcccgcggaccttctgcctctcagacagagcttagggtgcgagcgaactcccgggacgtccagacttggggaaggcgcggggtggctatgggtctccgacccctcccatttctcgcaagttacacaaaagggagacgcggacatgcacaaagtttgcctgtggaaggcggtgcgcgaccccgacgccggctcgggctagggtcgcacccaggctgccgccgccagcagccgcgaaaagaggttggagcaaggaagggggatgggggtgagagaggaaggtgaaacgaggcggagaacgcagggaaaagcgaggggctcctagcttcctgggctgtcccgactcctcctcctcctccccagggcccaagagaaaggaaagggcaacgattcaagagcgaaggactggctttagggacgctgcgttttcggttttccccacgtgctccttcccccttcccccctgtctgaatgtctctcgcctcccccgacccccgcttccaaggcagggactaagtcggggtctgggctcagggtcgccccctacccttctcgccccgggctggcgcggaaccagggagaccagcgcctcgcccgctccctctcagcgggccggagcgcgactccctggggcagggctgggccgaaagcggggatgcgctggacgtccgcaagcgggggcggagaggagaggggtcccattgacggacccccggcttctctgcattaaagacttgggttaaggtcttggggggtatcgcgtccccaccgtgcagcctccccccgccttccgaggcgcggcacccacctccagcgcccgagccgtccaggcggccagcaggagcagtgccaaaccgggcagcatcgcgaccctgcgcggggcaccgagtgcgctgctgtgcgagtgggatccgccgcgtccttgctctgcccgcgccgccaccgccgccgtctcccggggcccccgcgcacgctcctccgcgtgctctcgcctaccgctgccgaggaaactgacggagcccgagcgcggcggcggggctcagagccaggcgagtcagctgatccggcccaccccgctcggcacccgagagagacccctagcggcgccgccggggaactgcgcccgctcgcgccgggaggggccctcgcgccccgcgcccacaggtgcacgcgcccttggcgccgcctgcaccccacgcgccccctccgctccccggccgacggcccacctgggcttcgtgaacagtgggagggagagtctggggccaggagagggacggtgcaggatcagggaaaggtgagtcctaggacgctgaggctctagaaaagtcgagagcgctcctgctcgtccccgtgagcttgaatcatccgaccccgcaggcctcccgggggtgtcgtataaaggactgctgctagggtgcgtttttatccgcatttcgttttttctctcggtttggagaggtggggcaggcgtttctggaagagaatgagaacgagtgaagcttaaaggaaataggattttctttgcttgttgagacagcaaaacctcattttttaacccccaacgtcaaaagcaggcacgagcaacctggaatttctatctttagaacgaaccaaaggagcaaggcgcaggacctggcaaagaagcggccaacccatttacttcttcttgaaagcagggttctgggcttgggttttgtttctttcttatatttttgtttgtttttggttttgttttgttaaagggggtggtcagtgtggattttgcggggcggggggtctttttttgttgttaagcagggatgtaacatccatctgagttggggaagaaggaaaaattaggagagatcattcgtattcgacccccgtaaatgaggacttctgacctcaaacgctgcccttgttcttcattgtgtctgtcctgaattatagaaatgaaccttctgccatgccactttctcctggattaaacacaaaccgtccactgtccagttagtgtccagatagtttagaatgctctagaactgcccagatatatcccctgctcttgacctgaagtagcatttagttaccaagccacagcccactccacacagggcttggagcgaaggactgaagccagggagtgctctggcccttctgagggctgcactgcagcctgccttctctcccttgctcattgcgctgacaagggtgcctaggcccgggaaggatggctcagccagcggggtacagacttccttcctgggaagtcatttctgtaccagctcccctaaatgttgtcttgtgtgtcttttcccgcactaggcattcagtcttgactcttggattacttttgcccctgaatgtcctttggatgtcctcaacaaataaggacaaatatttattgtcatgcagtatttgtttatacgcttcatgtcatttacttcctacaaaagccaaagaggctgttactattattcctatttatacatcaggaaaatgaagctaatgaactcccaaatctaatagcaagtaagtgacatgaagctgggacagcagggaaaagcctaaagtgacaggacaaacccagttgttcactttctgcaccacatttacccaccgcaattccgtatttgttccgggtctgcatgagcaaataaggcaaaaaagaaggtatctgaatgcaaagagaaacgtggtccaaagctacaaatcttgcagagtccactgcaaaatgcaaacgtgagaccctttgttac

SEQ ID NO: 41 - DNA, 4489 bp, Homo Sapiens
caaaaagatttaaaaagacaatgcacaaaagatttaagaattaaaaagacaattctagaaagaggaaattcaaatagccggtaagtttttgaaaaagtgctcaaactctttagtgtcctgggcagaataaattaaaacaacaataagataaagccacattcatcaagttgggaaaaaggaaaaataactcttggtgagacagtaaaagtaaagggatctaccatatactgctgtcggggtatacattggtgtatctactttggaaaaggcataactagtgaagttgaagataaacatacgtactctacaaaaacccatggtaatgtacattaagaatacatgtacaagaacattcataatagcattgttcataactactaaaaacggaacacaatccaaatgtttattaatattagactaaactgtggctcatttccattaagactttttatactatacttattatactatagattactacaatccaatataagaactagagctaaatgtactaatagagttatatcccagctgcatgagagaaaaagatacataatgatatgtaatatataatccacttacatacaattaagaaacaggcaaaacgaacctaaattgcttaggaatgctgacataggtggttaagaaatactaagaaagaaagcagtaaatgattgccataaaaatcagtatagtgttaaccactgaaaagaattgaggaaagggatgatcaggaatagaatggagaggggagcttctcaggtgccacagacgttctagttcttgactgtggcagcgcttacatagagttcacactttatagtttttcattatactatgtatcgatgtttgtatgcttaaatactaaatgtatggaaaaagacacaaaatatttaaaattgtagctaaggcacattaactgccttgctggtatttttttttttcattacaaagtggcagacaattggttacactataaagacagacaattggttacactacaaagaaaattttaaagcacaggagtctagttttgattccatcggacatgattaccgtacacaatacagaagatactaagggctaagcaatgatgcataaacggggtccactgcccaaacttacagaaagcaaaacgtggaaaattagtaactttaactgatagtgtacacctaaagaacctacaccggccgggcgcggtggctcacgcctgtaatcccagcactttgggaggccgaggcgggaggatcatttgaggtcaagagatcgagaccagcctgaccaacatggtgaaaccccgtccctactgaaaacacaaaaaaattagccaggcgtggtggcacatgcctgtagtttcagctactcgggagggtgaggcaggagaactgcttgaacccaggagacagaggttgcagtgagccgagatcgcgccactgcactcgtctgggagacagagcgagactccgtctcaaaacaaaaaacaaacaaaaagaacccacccaacagaattaagtaccaacataataaatacgaagaattttagattcttggtttttaaaaaacatacaaagatgatattccttcaaaatatctttacaaaacatattgagactgtgatgctttatattgattgtatgaaaacaatgaaaaagaaccagcactgtttcactataaaagctttactaatgtaaatttataaatcctttcttaaatattttgagttaattctaattttatgatagaaattcattattttcagcaaaaacagctggcatttgggaaaccaaaggctcaaaaactaagaatagtaaccaaagaaacttgacaaaacagtccttttaaaactctcatctacactataaggggaaactttgatcacgtcccttctccttcatcaatcgtagaactcaacattaaggactacacaatcccacatccctctccgagaaaaagcaaaggctttgtgttgtagcaacaacgcaagacatggagggaagctccactcaagacttccctgcctgctccttccccaaagccactccagaataccagggagggttgagaggtaaggcatgaagggcgcaatatccaatatgagcaacgcgtgtgatgcatctggtcaaaatgcatacagaggacttgtctctgtccctagatagaagtcctccgtcctgcagtcatgagggtcaattgctgaggcttcacagttcccttctctcttacactcggaccgtcacgctcctcacctactaccccgatgcagaggtagactcaggatccctgcacttgtcaaggattcctcggcaagctcacggggcgggagtggccacaagacggagctcgcctggtcctggccttcccggcctatacaagcctgcccccttcccaattcccaatctccacagccttccatcctcccactttcgattcaccttgcgccaccgacgcccctggccttcgtttgcagcaagtttacccccaccattacctctcgcataaaagcctgcatttaccaggtcaaagaggggaaccaacgcctgcaggaatcgcttcaccgaatcgcctggccgcgtcctctgctagacttcacctgccgctgcggaccgtacacaaccactcccggcatgccccgcgcacgcactacctctcccaccccgcccctctcccgcccaaacacgtgacctcctttcgtctccgtccacgcccacttccgttcctccactttcccttaggaaggaggagggagctgggggtgttaaaagcgtagcgacttcctcctcctccccgcccccgctcctgtacctcccgctacaatgtcttccgggtcgctagcgcctcgacgccttctgggaaaatagctcatttcctcccctccccctcctcctgccttcaaccaaccagccacccgtcagagagggacatgcgcagtgagtgcctcccgtctcttctacccgaaccccccctcccccccaagcagagagaccccagcagcagcagcagctgatgatgaagagagaggcagtggcagagggggggcaccttttatttctatttttaaagggacaggacactaattctaccccacttcaaccttgaattcaggggggtggggggaaggcggctgagttccttcccccaccctccagccctgagccctgagagggggattgagcctgagagaggagaaggagtttcttcttcttcgaaaacccccatccacgactcctaccccctcacccctccaactcgcctccctccctccaccctcctcctctttggccgtgagaggaggagagaaagaaaccaaaagcctcttagcaacacagaccctttgctgctgctgttgctgctgctgctgctgttgctgctgctgctgctactgctgctgctgctactgctgctgcttggccctggctggagacatctcactacacccaggagcagccacttccccagctctcctcctcctccttcgcctcctcctcctccactccccccctttattaccctttgtgtcatcctccacagctccagggaaggcactcaaaagtggggggcaggaaaggtaagtgtgtctgtgggggcttcattgccttcctctggctctgactttcactccggggcaacagtagcaccaaaccacatacgcagtggagctccggggtgaggagggggtggtgctggggggggtgaaggaggggttggagtagggaggggtgtgtgaggtggggtgcccatcctgtcaggggaggaagggcacttttatttttatttgctgttgtcaaaagtggtttctctcctccatctaacatctgattgtgtcttgctccagtgggggagaatacaaaaacaaccccctccttcctccaatgaggcgccagggaaagagacagaaagaggcacactttctagatgtcacttaaaaaaaattcattggagagctctttttctccaggaaaagctccactgcatttgtttctgagtgggaaaatgtcgggatctggattgtattggaactgcttatccatttgtagacctgagtgttttcccctttttggtcctgtatgagatttggatattgacttcagtgttggaagacttgattggtttttgctttaagggtttcattttccattttttcgttttgtctgacttccatggaaaatttcaaatttttagttggtagaggcctttggttaggttttgacttgcattattgctttttttttggttaaatgtctgtttcatatatcagtatataaagtccaaagctctaaaatgcttaaagtttaaatgccactgctattgtctgttcccacatacgttcctgatacttattttccatatgatgagaatattagctattttataattaatctgggtatatttgtaatctttgtaacttgtctgaacaagtaatccccattgaaaactttatgttgttctggctgcatggaaggccaaacctctccatcaatagtttgctgga

SEQ ID NO: 42 - DNA, 4395 bp, Homo Sapiens
ctccctctgcatgttttgtccaagttccacactgcactgacttctgtgtttctgaggtggtttgcttttctgttaaaaaaaaaaaaaagttttaaaaagagccatcatccaattttctattgtactaaaaatagaggacattcttataatatccattagtaaattaatttttaaatgttgtcttagccaaaccaatcaattatacatattataacaggttcagatattctggaatattaacagtaggaggaaaataggaaaatacaaaataattcgaggtcttccactagcatttttctaagtaaacacacctgttcctttcttggttgccccagacaaatggaggatgattaaacttgctacaactgaaacagaaaagaaaaattagagataaaatacactgaaatgatcaaatcccataaaaacataacataatttcaagataaaataatatcaaagcagattaattttttcattgttaactgttagaagtcgattcagaacttgcaaaaaccaatttgaaatgtacaaatcaggaaaccttgggactcccttaaggaactaatgcaagttaagaatggatgagacccaaactcctaaggcaaatacatcattcactctaaaggcaacatgtcaatttactcatgtcacacacagtacagtgggactacaggagtcacactgtatctaaactacccttagggaatggctctgccagcatctctgaatgaagagaggggccagaaggtaaaaaggaggaaaaggagaggcaaacaatgagaacagctccatgactgttcctgacatactgcagtgtggctgtattttagaaaataaatacttagacaaatcctacagactgtggaggaggagaataagcaagaaacagattaatgtggattgtgggcattaagcaccattattggaatgttgcctacaaaaatgttctgaacctccaagtaaccccgtccctcagcactttctaagctgtgaaattaatctcttctaaccttaacttgatttaataccaaatcaatatatagaaattgattattaatttgagaaacgtgatttccgaaagcattatattgggtcaggtttccagtgtcaaagagactgtgatctgtaacttaacagtaaatctgcaatgccattataatctaaacttgttttacttccgtattcttgatctaatcaacatttttacaagacaaaacactagcaaaatagtaagtaagctagtcttcataatttgatttttcttctattttttcttattcattttgtcatccaacgacataaaaggtctatgttttcacattttcacttaaaatgaattcgggggagagaacaattcacaaatatttcctgaattaaagctcaccacaggcttatacatttatacttaaacatcactctaagaaacgtatctaggtcttgatattaatatttaaaatattgtcaattgtgtgttactttatgctctagccagttcatttgcattttaaattaaggcactggctgctgttgttactgtgtgtttccacaggaaaaaaaaaatcaatttaatttgtcatgattctgctcacacccagaacacacaggtatgcacatccttcagcatcaggatgtgtatttgtttactccgctcttcctgttttgatgaaatcacattatagaccacgtactgtgtttaactcagcagcaaacccctctcaactgcgtggcccgcgatcaacactctcatctttgcttagtaatgatacatttccaccacacattttcttatactgccttttactcgatgactcgtgatactattttcctctcattccttcccacctctacactgcccgcgttaccacacacccataaagcgacatcagcggtctccagggcggaaaggggtggaagctgaccctcgcccttccctccagcgctggcttcaggtgtgccttctgctacctcctgtactgcgaacaggggcccgccgagctccgggagcccctagaagaggaagactcctctggccccactaggtatcatccgcgctctcccgctttccacctgcgccctcgcttgggccaatctctgccgcacgtgtccatccctgaactgcacgctatcctccacccccggggggttcctgcgcactgaaagaccgttctccggcaggttttgggatccggcgacggctgaccgcgcgccgcccccacgcccggttccacgatgctgcaatacagaaagtttacgtcggccccgacccgcgcgggactgcagggtccgccggagcgcggcgcagaggcttttcctgcgcgttcggccccgggaaaggggcgggagggctggctccgggagcgcacgggcgcggcggggagggtactcactgtgaagcacgctgcgcccatggatcatgtctgtgcgttacaccagaggctccgggctccactaattccatttagagacgggaagacttccagtggcggggggaggacagggtcgagaggtgttaaagacgcaaagcaagaaggaaataaaggggggccgagagggagaccgagaggaagggggagctccgagcccacgctgcagccagatccggatgagtccgtcctccgccccgggcgggctctcgctctcgctggccctcagcgccgcgcagccagcagcatccccaccgtgacgctcgcatcacacccgggcgccggccgccaccatccgcgccgccgccgtcaggaccctcctcccgggcatcgtcgccgccgcggggtcgggaggacgcggcgcgcgggaggcggcggtcgcagggcgagccccgggacgccccgagccggggccggggccggggagagggcgcagcgaggtgggggccagtccagaccgacggcagcgacggagcgggcggcggcggcggcgccggcggcggcggggtggctcagtccccagtctcagacgcgccgcgcagcaggtcggagcagcctccccgggaggatgtccagcggcagcgctcctcgctccagcccttggggatcttccgctgaggcattgaaggcaggaagaaggggtccgtcatcggctcgccgggctgcgcgccacctctgctatcttgcggaaagaggagcgggtgggtgggcgtctgggaggcgggctggagggcggtgcaggggagcggggcggccggggggggggccggggggcggggaagggagggaggagaaaggagccggaagagggcagagttaccaaatgggctccttagtcatggcttggggctccacgaccctcctggaagcccggagcctgggtgggatagcgaggctgcgcgcggccggcgccccggggctggtgcgcggcagaatggggccgcggcggcggcagcaaggacatcccagccgcgcggatctgggggaggggcggggagggggtgaggacccggctgggatccgcggctcggcccgccagggcgcagagagaggatgcagccgcaaatcccgagccggatcctcgtgccggacggaaggcgtggaagcgggaggggccttcgtgtgaaaatcccttgtggggtttggtgtttcactttttaaaggttagaccttgcgggctctctgcctcccaccccttcttttccatccgcgtaaaggaactgggcgccccctctccctccctccctggggcgcaggtttcgccgcggactccgcgctcagcttgggagacacggcaggggcgcgccccagggaaaggcggccgtaaaagtttcgcggttgagcactgggcctgatgtccagtccccccaccaaattactcctgcaaagacgcgggcttcttgcaattgagccccccacctcgaggtatttaaaaccaccccaaggcacacacggacccccgttcccccgcgccacttcctcctacaggctcgcgcggcgcgttaaagtctgggagacacgagttgcggggaaacagcaccggaagagcccgggcttgtaaaatgcgaatcaatgaatacgaaataagggcaaccgcgaggcagcgccgggaagggctggagcgcgcgggggtgcagggagtccctccctgggcgccgcaacggcacctcctccctttcccggctccgtcccgccctccctcggcctctgcggacgcgacccacgcagaccacagccgagcccgccggaccccgggactacggaagccatcccgtccggccacccacacccgcgccgcggctggggcttgggttggggactgtggcggcgaagaagccggggtaggaagagctaatggcaatggcggggtcgccggggggcggggggtcagcagcagacgctgagctgtgaagactagggtggccccgaaaggccgaggaaaggagaaagggccatgagaagagtctggcga

SEQ ID NO: 43 - DNA, 10490 bp, Homo Sapiens
agaaggtgcctgcttccccttcgccttctgccatgactgtaagttccctgaactgggagtcgattaaacctctttcctttataaattacctaggctcaagtatttctttatagcagtgtgaaaacaaactaataccccttccctgaggcgccttctccttaggcaacccgctgcccccatgctcctcctctgccccctgttctttcttttcccctcatgaggcccaagtgataaacggggccagccccagtcccagccccagccccagccccatcctactgcaggcctgtgtggctgctggagaggccgtgttcctttcctctccccgagcctgcctgatatgctttctggatcctggaggaaactgaccccctattctcatactggtgcaacatcttccaagacctcaaagctgtaccatttgagccagtcttttttcttatctccacttgctagggctgtcattgggacagtcctagagggtggtgccaatggatgaatggatggatggacagtagtccagggatgatgtccctgtctgtcctgaaccgggcctttcctccaatgagaagccttcctgagtgagtatatacagtcatcccttggtatccatggaggattagttctagggtccccgggaatgccaaaatccatggatgctcaagtctctgatataacgtggcctagtatttacgtataagctatgcacatcctcccgtatacgttagaccgttactagattatttatgatgtgtaatacaatgcagatgctacataaatggtcgtgatactgtattctttagggaatgatgacaagaacaaagtctgcacatgttcaatagaaacataaccgtccaatttattttctgaatattttccatctgctgttgctgaatctacagatgcagagctcctggatacgagagccaagtgtgctttgagagtagggtgggtgaggttgctaatgagtacaggggagcaggtgttgatcaggaggaccctgcactggggcatctggacgtcctgcctcaggacttgagactccagttggatggcacaggtagactcagcccaggtcaaagccgtccccttgaagtttctttttatcccaagctctttctggaccctggaattcggcatcccctaggccctgcgtggaaggacagatgaaccaggttttagataacatgtctagaagagtgagcccctactgtgtgcccggcactttccccacaggatcctctagctagaatatccaagggtcatggagagaaatacccagttaaaatatcagaaaagaaaaagtgataccattagagacactaaaaagaccattaggtaatagtattagcttttgtattctgagatccaatagcagcagtcacttccctccaccgctatgtgtatcccaggaccaccctgggcggggagggctgcggttagggagcagccatggatgctctgatgctggccctgggcctcgggggtgacagtgatgaggaactgggtgcacacatgagtggggcagccgggcctggccagagaagcagcacacacgtgcacagacgtgtttacccacatacacatgtgcacgcacgtgcacaaacacattgcaggcaggcatgttgacgcctcaggcagcggaggaccctgactctgggcgctgctgacccgggcaaggccccactgtgattcgtgccatgacctcagaatgtcactggtgcttagcacctgtctgctctctggcctgcctcagtggtctacagcagttacacacaggcagtggtatctgtgagcagctctgtggactcaaaggttttctccctgagaggcatgacccaggccagctgattcatcagaatcaggtgagcgtgacctgctctcttccctccaggcggacttggggacagtggctacggtgcgggcggtgttggcctctgtggggcagctaccgaggagggtcatccctgagcactcaccaggcgcccgttctacactgcccgtgtagacgattggctctttcgtctccatggtggcttcgtagagtgggtgctgttcccaaatgtccccattcgacagatgagacgtctggggtcagagaggcagtaaccggcctgggaatccggacatgaccctgagttttgctctcagccctgccgtgtgctgtgctggaattcaggcctgaaccctgtgacctccctgccctagatcccaaatctgcccaggtttcccatcccgatggggcagagcctggtcctggcagagccactggtatagagccactggtacagatccactgacggtcctcagaacacctctgtgccctaagctgggtcctgatggtcgctgtgggccccactgaacacacatggtcccttgtccaggggagcctgctgcccttgggcagctgtggaaaatgaaggagccctggagggctggctgaggggagactatcttcccttgtgttcaaaggggtccgggcactagggttctccccaggtatttcttgctctgcgtggtcctcttgaggcctcgccctccttttgcctcgagtattcccaggagggacggtccatccagctgttctccaggaccaaggacccactgttcttcctcagtgacccaggaaaatgaagcctcctcctgttgggacggctcagaatggtggactccacagtccctccgcgagagacgtggtttccatgcgtacaatagatctttctcatcccccaaacccaacaccctcctgctcaacaggcgttattcctaaagtggcttcactgttcagactgaagagccacggtagccaaagtgatgagcggagtagaaccgagcagtcgggagagatcttgttccctgtaggaaactgggcatcgctgaggccctgagcatcccaggaggccgattgcacagagacctctggtcgctgaccccagtctgcctccacatccctggaatagcccatcatgggcccttcacccttggcaggtggaaaccattcaacctgctggggccggtgtgtccccatttcatggcattgggggacaacaggattctctgtctaggtcccactgtactcaagtccttgggaagatgcccacccctgcttgggacttgagactccagagactggagcagctgtgggccactgggtctggcccctttttccctgggggcggcggtggaatgggggttacgcagccagccagcatctgggagcccggcgagagcggttcaggtgttctccgaagccgccgcgtacagtgtgacctttagacaattctgtctcacaggatggacgtggtagaggtcgcgggcagttggtgggcacaagagcgagaggacatcattatgaaatacgaaaaggtacaagtcggtctgcttcttggagggaggcctcttccagtgtgccctggtcaaagggtcctgggctccctaggagcacagggcagggacgggtggccaatgcccccaggcccttgcaccctttaccttggacccctcaccaaggctccctctgggctacagggacaccgagctgggctgccagaggacaaggggcctaagccttttcgaagctacaacaacaacgtcgatcatttggggattgtacagtgagtcctctgcactcccctcacccctaaagcacctgtctcagctcagggatgggtttgcttttagaaaggcctttctgacgcaggacatgtctcaccaggtcgggtcaacctcctttccagggacagaactcctccctgactcccctgcaggtccagcccgaggttgttaggccagaggtgtggggcccatctagggagccggtgggaatggagactgggctaggtcaggcccctgggcgctcagcagttctgtcggcaagtgagcacaagaggagcggggcagcctgagggtctggccctgtctacttggagacaaccccggtgagatgcaagggttatggccacagggtgaggggacgcctggcccagcctcagggctgttgtccagcaggtctctgagggcccacctgcccctgttctcccccattcccctagagctacagccctcactgtcccgtgaggggaaaaggcatggtgacaatgggggctgtagccctaggagaacgggggagaagatgggcagggccccgttctgggcatctcacggtgaggccagggaggcagcagggctcgcggctaaagacctgggtctggtgctgggaagggatctggggccgggtaagaggagcccagccaggagcccatccctcagggatcacaggatggagagacagaggatccctggggaggtagggcgggagggagctgacgagccgtgccacttctgaaacgcagggtgtgtggctcgggtgcagggagaggcaggtggatgctgggaggtcagaacctgcaagggccttggggctgtcaagtggggtgggcccctggtgcagccagagtacaccgggcaggtctcagggcaggctcccttgaccctggcggggggatgtggtcactccctgagggactcctgtcagggcccggtcgcccaccctgggcggcccccatcccatctcagggctaacctttctcagctccagcagaaagcaccacctcgagtccaggacgggcagccccactgggcagcctgaccgccccccacgccaggggccccagtaaccccggccaggctgtccctacactccttcttctcccaggtcctgcccctcctgggagtcagccccacaggaaggcccttgtcctcccttccctgtgccttctcctgggctgagccctgagctggaaagggacagagccagtcctttctgggggtcggcacccaggctggggccgctccaggccccgtgcagttcctcagctctgcctgggttgccttacagtgagacggagctgcctcctctgactgcgcgggaggcgaaggtaagagcctgatgcgtggaggggctggtccagggacgtagggactgggcgggtggtcagtgaggcagaggaagcagctggcctgagcggtggcgggtgagggcaacacgctgtcactgggaggggcagcagtccctgctggacctgaccccaggttgctgttcactttggcagtttgataaaattccaaaaggagaaccacagtcctggcttgggggtggctgcgcgcttgtgtcaggaccccacctagaggctgggacctaagactggtgtgtctgtggcctgaggatggtacatcccggggtcccaaagccagcccactggtgctcatttgctcaaaggctctcagcccttgaggtctgcccttccctggctccttccagctggctcccaccagggctccagagcccaagacccagcatccgcgggcggctctgggaagcctggcagctccgctaactccaacatgcctcatttgacagcaaattcggcgggagatcagccgaaagagcaagtgggtggatatgctgggagactgggagaaatacaaaagcagcagaaaggtaacgtgtggagggaggaagcactctctgcagagacaggggacaggcacccatggctgtggcctggcaccatcagcctctcagagggtgggcggcacactgtcctcgcccagaggactgcaggcctggtcgccagatttcctgcctattcgtgcaagcgtcaccttgcagggagggaatctgaatctagggctgggactacccggagctcaaggctagggatgccctggtgacctgaaggaaggaaaaggttcagatcagagtttcgactctgagtgtccatccactctttcagtcctgggaagggagaccctgtcccagcttgatctcacctctactgaggaatcatggggccaaaaccgacaatttccagaatccccgggctctggtcctcactggggtcaccccgtggcctgtgacaccagatcgttttctgcccacagctcatagatcgagcgtacaagggaatgcccatgaacatccggggcccgatgtggtcagtcctcctgaacattgaggaaatgaagttgaaaaaccccggaagataccaggtacgctcagccagagcacaacaaacaggacaggccgtgtcggggcccaggtctccagctggagggaacgtcaagaccaccctggggagctgggggtgaaggtcagatgaacaccctgggcacagatggtgacacagtcaccacagacaaactcagctctggtgaccctccctggcttcagtaacaagccaaaatgcagctttctgcagaaggaaaccttccttctgtccttccttcccgaagtgctgactgtgggctgactgccactgggggcagggagtcttccatctgttctgagactgcttcctcctcttggccctgccctacagatcatgaaggagaagggcaagaggtcatctgagcacatccagcgcatcgaccgggacgtaagcgggacattaaggaagcatatattcttcagggatcgatacggaaccaagtaagcctacgggagccacagggtcccagcagagatggggtgaatgagagggatgggggcttccccggagcagaagccagggtcacccaggagggatgacacagctgccaagagctctcccggcccagggagcagccggcaccatgaaccgagcacctccctggttccaagccctgggccagactggaacatgtggggccagaacccaggaggatcctgaggagatggaaggcagcaaacaaaatcatgcacaatggtgaagggtgctctccctgacccatggggacccatggtaggacccacgggagggtggcaggatagagggcccatgagccccccccaggcaacagtgacagcaccaaatgctgggagaattaggggtcctggaaactctcatccaggtccgctgggaacatgacatggcacagccacgttggcagcccgttgggcagtggctcacaaagctcgatggacttgaaccacacatccccaaagtgtcacagatattgaacccactgatttgcaaactgacatccacatgaaaccagcatgccaggttcactgcttgactcctcgtcactcacacacggagccttcggggacggccttcaacacggggatggggagagcaaggctggtcctcccttcaaacggaagacccagtgagaaaagggaacgagccggtgatgcccgcacgaacgtgggtggatcctagatgcattttgctgagggacagaagccagacccaataagctaccacagtaggattcccattcctaggccattctggaaaaggccaaaccacagggactgagaagcagtctgggtggccaggggctgacggatcggggagaggctgggtgcataggggccaccctggagacttggaggatgaaggagtcgccccaggaggggctggagcggtggccgggagactctgcacattggtttggaaccgtggaggaactgtacacccacagactgaactggcgtgtgtgcaaactgaaaaaaaaaaaaaaaaatcattcagagtgaaaaggatcaggcaagtcactgtacaactgggctatttgcatgtcacagatgtggattttactgaaacatttcttcaagagtctcaggccctgaagagctcactgcttatctggtgaaacatctgaacctgaaatgggatttgctgttaggctttgtagacaaagtgaaattaacaacatctgcacaaaacaaaccaaagccccctttctctgtttcctaggcagcgggaactactccacatcctcctggcatatgaggagtacaacccggtgagtattcccggcagtgaggttcccgggccatatttccatattgacaggagtgggtgtctggtgggggtgtcgttgcttcttttaaagttagtatttgtgacccaccaggatataggaggtaggatgtcagctcaccgctggcataaacctccaaggaagggggtggtctcaaggggtcaagctgagacacagaggagtcagggcctggactcctggtgtcacctgggcctgaccaccacttctcagaacaagaaatgacgccctcctcctggggctgccccaaagcccaggagcttggcagcatcgcacacaggatggtgctatcagcagacattttggacaaggtgctgaagtgcctgatggacttggctcttgtcatgaaatgaatgtgcatcctgaggaagcctctttttcagaggaagcctctccttcagaggaagcctctccagtcacctctgccctctccaatgacatgagtcctcccaggtgacctcagccctcccaggtgatgtccttccatggtgactctggctcttgcaggaggtgggctactgcagggacctgagccacatcgccgccttgttcctcctctatcttcctgaggaggatgcattctgggcactggtgcagctgctggccagtgagaggcactccctgcagggtaagtgaacagctgccccggggacctcctgcagccagacctggggatggccaccctggccaggtgatcacagctttcagccaaggcaccctccttgtgtcgccagcttgttgggagactttaggatgtctctgctgagggtcccacaggagtccacggctgacccccaaagcccaaatcagacgcctctcatccccatcagcagagggcatctcatcctccccgtggccaccctctgtgtcctggagccacgccctccggctctgattctgtgcagctgactctcccctccctgagagtcctcctgccctccagctgcccgggctcctgctgccatcggtgcccacgaatgggccgaccaagcccaggtggcagcatctccccatcccctgttccctggcccgaccccactaccaggagatgaccgggaagcccagcgcccacccagttccggccaccctgtcgtggcctgaaagtcaggcttgccctttttgcaccctggcccaggaggcctccaggggaacctccagccaggctccagggaatgttcccgccccacctccccagggtaaaggccgcatgttggggtcaccagatgggagggtgggaggccttggggtttgggggcctctccagctgcccagctcttgcagctgatggctccacatcttgggggaaggctctgatttcatgatgggctgggggcttctcaggatttcacagcccaaatggcgggaccgtccaggggctccaagaccaacaggagcatgtggtagccacgtcacaacccaagaccatggggcatcaggtgagtttatggtcccctcagctcttcccagaggccctgcctcccgtggggctgtaggagcaggggggctggagcccctcgtggggctggtgactggctgagtcccagccagggcctgacctgggacgtcgggttctccatgggctgggagttggtttcctttcctgccctggaggagacagaggcacagggatgggggcccagctcccgcagagcagggcaaagggcagtgtgtccaccgggagtgtgggaaggtgacagtgttgtggggagctctggacaccgcccagtgttctgcactaggggaagggtcttcagaggccctggaagagggaggtttttagggcagcccagtggcctgagcacctctgttgcttccatcaggacaagaaagatctatgtgggcagtgttccccgttaggctgcctcatccggatattgattgacggggtaaggaggcatagggagaccctggctcagggaccttccttgccctgcagtgccctgcttccccagcccgggggtctggctcactcccagcccacaggaggctcaggcgggtccccaaaggacacacaagcaaaaccctctgcccaaggggggtcatcccagggccatggctggggctcaggcccagcctcatgggcagactgggccaggacccgacttgagagggctcagggaagcctcaagccctgggcaagcccctctctccaggagccacatccccactcaaatgagtgccccccatgaggagcttcaagaccttgtctgacccagcgtcctggagggctcaggcgaccctcatggggaaggtcactgactctggagactgaagccccagtgtgcgcagctcgagccaccagccccagcctggaaggaccaggttctttcacacctgctgtccccacagatctctctcgggctcaccctgcgcctgtgggacgtgtatctggtagaaggcgaacaggcgttgatgccgataacaagaatcgcctttaaggttcagcagagtaagtctacgtgtgcccagcggggcctggggagccctggggtcagaccccgactggcccgagggcagcttcctcacactgtcctcatgatcctctgttctggcccagagggaggtctggccaggtgggctgggcaggacactgtgacaccgagcccatcccccacatgacccagatgaaagtcgagagtgtggtgagcacttccctgtcc

SEQ ID NO: 44 - DNA, 6416 bp, Homo Sapiens
ctcccgactcacctgtgactgagggcaagaatgctttcttctcagagactcggtgtccccttttgtaaaatgaggctcattctgtccttccccaagggcttcagggaaactccagttagagcagtgaggtgctaggtaaactctgaggggcaccctaaccgccgtgtgaggtcaggaggtctgaattctctcatcccctctccccaggacaagggcacacaactggttccgttaagcccctctcttgctcagacgccatggagctggatctgtctccacctcatcttagcagctctccggaagacctttgcccagcccctgggacccctcctgggactccccggccccctgatacccctctgcctgaggaggtaaagaggtcccagcctctcctcatcccaaccaccggcaggtacgatggggcgtggggcttgggggaggtcagtgctggataatacacagaggcttgcaggccactgctcccttccccacacctctctccctttttcttcttgccacaggaaacttcgagaggaggagaggcgtgccacctccctcccctctatccccaaccccttccctgagctctgcagtcctccctcacagagcccaattctcgggggcccctccagtgcaagggggctgctcccccgcgatgccagccgcccccatgtgagttgtccctcagaagggaagggagggatgcacgggttctgggtctgtgggagatacacagccgcttccatggaggcaggggatcttggttaggagtccctgagggtctagcaggtgcggaaagggaatgaatcaccctttgcctcccctcaagtcgtgtgcaattcctggggcgcaggtagtaaaggtgtacagtgaggatggggcctgcaggtctgtggaggtggcagcaggtgccacagctcgccacgtgtgtgaaatgctggtgcagcgagctcacgccttgagcgacgagacctgggggctggtggagtgccacccccacctagcactgggtaagtcaggtgcatggaactatccgggctgggagatgatgccttgcatcttgggctaggcatgtggctcatccaggagatctggttgatctccaataacccctgctttttgcccttgtccccagagcggggtttggaggaccacgagtccgtggtggaagtgcaggctgcctggcccgtgggcggagatagccgcttcgtcttccggaaaaacttcgccaagtacgaactgttcaagagctccccagtgagtgcatgagggctgtctgggcgctgggatgccctgatcctcaacctggatgctggagccctgatccctgacacttgtctacccacagcactccctgttcccagaaaaaatggtctccagctgtctcgatgcacacactggtatatcccatgaagacctcatccaggtggggggaccccccatttcactgcagattcacgactccccagcattggccagtgcttctccacccttaagtcctgtgcctcccctctatgttgtagaaagagccaaatcacagtcctgtgtgactggggacagtcactttccctgcctgagcatcagtttcttctattaaatgggggcgagaaatgcatgtggagcatttccttgtaaaaacctgagggtgggctgggcacggtggctcatgcctataatcccagcactttgggaggctgaggcgggaggattacttaagcctagaagtttgagagtttgagaccagcctgggcaacataatgagacctcgtctctccaaaaaaaaaaaaaaaaaaaaaaaaaaggccaggaatggtggcatgagcctgtagtcccaggtgcttgggaggctgaggtgggaggatcacttgagctcgggaggtcgaggttgcagtgagctgtgatcgtgccaccgcactagcatgagaccctgtctcaaaaagaaaaagaaaaagagaaacatcctggtggtagaggggaagggaggaggtcagacctgtcactctcctctgctctcctctggctcagaacttcctgaatgctggcagctttcctgagatccagggctttctgcagctgcggggttcaggacggaagctttggaaacgctttttctgcttcttgcgccgatctggcctctattactccaccaagggcacctctaaggtaaggtcttgagggtaccagccccagcccctccagtccctggtccttttagaagttgccccttctctgctggaacctctgagcccttctccccctgggccccccaggccagccacctccagtttaccatctctccctacatccttgcctagctcacctgcccagggaggtagcaggagaaaagatgatcttagtttaagtcctggctctacttctatttgctgtgtgaccctgggtattcccctgcccctctctggtcctgaaatctccccacctggcttgtggggggaggtaatagtgggcgggatctacctgtaccaagtcctgctcactcatgctgcttaggatccgaggcacctgcagtacgtggcagatgtgaacgagtccaacgtgtacgtggtgacgcagggccgcaagctctacgggatgcccactgacttcggtttctgtgtcaaggtgaagacctggccaggcctggcccctggcctggggaagcaggaactgctcaggcccctggatcctgcccggggcttctgagccccaattcagacacctagactcctctccctgcaccctggcctgctggaaactcctggattcagctctgctatgtggagcaggggcagacatgtggtcctaaaggcagatatgggaccagtcaatttcctctctctgcagcccaacaagcttcgaaatggccacaaggggcttcggatcttctgcagtgaagatgagcagagccgcacctgctggctggctgccttccgcctcttcaaggtgagaccctgggagtggcatggggggctggcctggccagagggatccccagctctgccctcaggaagtctcaggaatgaggagggcatcacagccttgctctctgataacccccagtccaagcctgaagttataggaagtgcccatcgaaggcagaaacacagccctggtctgggcaagtcctggtctgaggggggcgtcacagccacgcccccaggacctctcgacctcaagctctctttctctccccacccccagtacggggtgcagctgtacaagaattaccagcaggcacagtctcgccatctgcatccatcttgtttgggctccccacccttggtgagtgtgcccaaggggatgggagggtgggtatgcaggccctgtcttacgggtacctgggccctgttctgacctctctcctctccttccatctccagagaagtgcctcagataataccctggtggccatggacttctctggccatgctgggcgtgtcattgagaacccccgggaggctctgagtgtggccctggaggaggcccaggcctggagggtgaggcctgctgtgtgtgtgtgtgtttgtgctggggacccactctctgggtgggatccctgaaataggagggaggaagagagggcggggggaggcccctggctgggaagaagtgctctaccttcctgaggtgctgggtaatgcccccaagcacgccccgactctcccgtatctcccactgctccacagaagaagacaaaccaccgcctcagcctgcccatgccagcctccggcacgagcctcagtgcaggtgggtgacggccccgagtcctggggcgggggctgcctcaacttctctttgtattcccagtggggagtagatggtataggggtcccctccccaaagtgaccgcccatgtccttccccaccacagccatccaccgcacccaactctggttccacgggcgcatttcccgtgaggagagccagcggcttattggacagcagggcttggtagacgggtaaggggcagggccgggcaacagacccagggataagagagactggggtccaggtggcagccatggtccttgggtagtaatgctgccccatctcctgtcttctggcagcctgttcctggtccgggagagtcagcggaacccccagggctttgtcctctctttgtgccacctgcagaaagtgaagcattatctcatcctgccggtgagcttccctgcgtccccggagtcctgcaatgagacacaggactcccagcaacctgtcctcctcaccaggcccctccagaggctccctggcccccagtgcgtctcccttttccctgcacaagaagtgggaggctgagtgcggtggctcacacctgtaatcccagcacttaggacggccaaggtgggagaatggcttgagcccaggagttcgagaccagcctgggcaacacagggagaccccatctctacaaataatttaaaaatgagccaggcatggtggtgcacacctgtagtccagctactcaggaggctgaggtgggagcattgcttgagcccagagggtcaaggctgcagtgagccatggtggcaccaccacactccagcctggatgacacagtgagaaaactgtctcaaaaaaaaaaaaagaaagaaaaagaaaaagaaaaaagaaaagaataaaaggaaatggtggggccctggcccaggagggagcttcccaagcctcgggcccctccctgaacttccaccccctttactgtaccccagagcgaggaggagggccgcctgtacttcagcatggatgatggccagacccgcttcactgacctgctgcagctcgtggagttccaccagctgaaccgcggcatcctgccgtgcttgctgcgccattgctgcacgcgggtggccctctgaccaggccgtggactggctcatgcctcagcccgccttcaggctgcccgccgcccctccacccatccagtggactctggggcgcggccacaggggacgggatgaggagcgggagggttccgccactccagttttctcctctgcttctttgcctccctcagatagaaaacagcccccactccagtccactcctgacccctctcctcaagggaaggccttgggtggccccctctccttctcctagctctggaggtgctgctctagggcagggaattatgggagaagtgggggcagcccaggcggtttcacgccccacactttgtacagaccgagaggccagttgatctgctctgttttatactagtgacaataaagattattttttgatacacctatgagttctgtctggcaaggcctggctggctgaatcaagaagggaaccagagctggacgtggtggctcatgcctgtaatcccagcactttgggaggccaaggtaggagaattgcttgagtccaggagtttgagaccagcctgggcaacatggcaagaccctgtccctacaaaaaataaaaaaatgagccgggcatggtggtgtgcacctgtagtcccagcttctcaggaggctgaggtgggaggatcccttgttccttgagcctgggatgtcaaggttgcagtgaactgagattgtgccgctgcactcagcctgagtgacagagtgagaccctgtctggaaaaaaaaagaggggagacctggagaggtgggcacctgtggaggccttggtggaagtgtcaaatggatcgaggccatgtctcagcctgcctggatgttcctcaagggcaggagtggttatctgagagtctccagtgcccaccatgcagcttgacacatagtaggcgcccagtcattgctaattaagtaagtgaatagacaagagaccatcatcccagagagattttctgacagtctaagtctagagaggtaattaacagggcctgggagttggagatgagtccgacagcatgcttgtcctccgctagtcctggactagctgacggatagttggccccagcatgcacacagttatgcatccagccccaccaccaagacacagaatggcctcatcacccccaacaagtccctgtgccccctactatcagccatgctccctcctacccaaactgaaacctcctttctgtcctagttctgccccttccagaaagccatataaatggagcctgctagcattcagccctctgcatctggcttccatctccaacacatccttcagcacccagagtgatcttttctcaaatataaattcaccactcccggcagggcactgtggctcacacctgtaatcccagcactttgggaggccgaggcgggcggatcacgaggtcaggagtttgagaccagcctggccaacatggcaaaaccccatctctactaaaaatacaaaaattagctgggcatggtggcgggcacctgtaatcccagctactagggaggctgaggcaggagaatagcttgaaccggggaggcagaggttgcagtgagccaaga

SEQ ID NO: 45 - DNA, 6001 bp, Homo Sapiens
tcttaacatcagaaggaacaaactctgaacacaccatctttaagaactgtaacactcaccgtgagggtccacggcttcattcttgaagtcagtgagaccaagaacccaccaattttggacacaaggtgacaggctgagggcggtggctcggtcctgggttttcctggggccttcccagggaatgttctggcacctgccgactgagccctgggaggtagccctggcatatagctccctgacatgatttgtcttccattttggggtgtcatatatgaagggaggtgactgttgtgatggtgctggcaggactgctgtccctgatgtggggtgggctgagttaggcctgaaatatgggcctccaggctgagtcctgccctctccaccacatccagggctgactgacacctctagtcagcccattctggccccttccccacatgccaggacaatgtagtccttgtcaccaatctgggcagtcagagttgggtcagtgggggacatgggattatgggcaagggtaactgacatctgctcagcctcaacgtacccgtctcaaatgcggccaggcggtggggtaagcaggaatgaggcaggggtggggttgccctgaggaggatgatcccaacgagggcgtgagcaggggacccaagttggaactaccacattgctttattgtacattagagcctctggctagggagcaggctggggactaggtaccccattctagcggggcacagcacaaagctcgtagggggatggggtcaccagaaagctgacgacacgagagtggctgggccggggctgtccggcggccacggagaagctgaagtgctgcagcagggaggtgaagaagaggaagagctccatgcgggccaggggctccccgaggcatgcacggcggcctgtggggaggggaggggcgtcagtgagcctggctcctgggtgatacccctgcaagactccacggaaggggacagggagccgggctccccacaggcacctgctgagaaaggcaggaaggcctccggcttcacaaagtggccctgggcatccaggaagtgttcggggtggaagcggaagggcttcttccagacggcctcatccttcagcaccgatgacaggttggtgatgagtgtcgttccctgggcaggagatgcagggtgagagtggggactggactctaggatgctgggacccctgccaccaaacacacgggggacacacactgcctggcacacagctggactctgtcaactagtcctgcgcccgagaagctccacagtaccctctccgaccccacagcagggcgcagtcacacctctcagaggcacccacactgccccctctccctgcaggcgctgggtcctccaacattctggcaggtcctgatttgtcttccccactagactggggctctggatggacaggccagccctgcctatactctggaccccccatccaagcggggacagtcagtgtggtggcattgaggactaggtggccagggttcctagagtgggcccacctggcagtagccatgctggggctatcaccaggggctggtgctgagctggggtgaggagggcgccaggcctaccttagggatgcggaagccctgtacttcgatgtcacgggatgtcatatgggtcacactcagggggatgatgtccccaaagcgctgcacctcgtgaatcacggcagtggtgcagggcatgtgagcctggtcacccatctctggtcgccgcacctgccctatcacgtcgtcgatctcctgttggacacggactggacagacatgcgtccccacaatgggtcagcacccaggggacactctccttcctcctgtgttggaggaagttaggcttacaggagcctggccacgcctgtgctggaagccccgggtgtcccagctaagcccaggggcccccagctgtacccttcctccctcagtccctgccttgggccccagctgggctcacgctgcacatccaggtgtaggatcatgagcaggaggccccaggccagcgtggtcgaggtggtcaccatcccggcaaggaacaggttacccaccactatgcgcaggttctcatcattgaagctgctctcagggctccccttggcctgagcagggccgagaggatactcaggggatagaacggggtagcccccaaatgacctccaattctgcacctgtcagcccagatgcggctcgccgggtgatgcactggtccaaccttttgcccagcctcccctcattcctcctgggacgttcaacccaccacccttgccccccaccgtggcagccactctcaccttctccttctttgccaggaaggcctcagtcaggtctcggggtggctgggctgggtcccaggtcatcctgtgctcagttagcagctcatccagctgggtcaggaaagccttttggaagcgtaggaccttgccagccagcgctgggatgtgcgggaggacggggacagcattcagcacctacaccagacagaacggggtctcaatccctcctgtgctctgcgttcacctggaccagtctcaggccccagccatctccaggaagacccagggcctgcctgtccttaccactgacctcaccaagtccctccccaagtgccagcctccaccctctctctccttgcccagaggagaaacctaaaatcgaaatctccaacgtggacgggggtacagagtccttggcctctcctggtgccccctgacccgggcacacctctcccacgaccatgtctgagatgtcccctcctcctccaggcccttcttacagtggggtctcctggaatgtcctttcccaaacccatctatgcaaatcctgcccttcggaggccccagtccagccccggcacctctcaggagctcgccctgcagagactcctcggtctctcgctccgcacctcgcgcaggaagcccgactcctccttcagtccctcctgagctaggtccagcagcctgaggaagcgagggtcgtcgtactcgaagcggcgcccgcaggtgagggaggcgatcacgttgctcacggctttgtccaagaggccgttggggcgaaaggggcgtcctgggggtgggagatgcgggtaaggggttgccttctccgtcccccgccttcccagttcccgctttgtgcccttctgcccatcacccaccggcttggtcggcgaaggcggcacaaaggcaggcggcctcctcggtcacccactgctccagcgacttcttgcccaggcccaagttgcgcaaggtggacacggagaagcgcctctgctcgcgccacgcgggcccatagcgcgacaggatcacccctgggggcgggacgggcacgtgggcgttgccatgaaggccttggccccaccctccgccacccactccaaccctggcgctccacaaggtctcccgcagtccctagcccggtccagctgggcacagggcccactctttgctcacccacattgctcccctgcctggggcggggtttggccccacctcgtctctgcccaccctgaccacctttccactcaaggaagatcccgcccgtcccgcccacactgagcccgcagcataggcgcggtccccgccaccgccacttcgacgcatcagcctcgcccaccgggcttctggcgggtctgggcagtagccccgccccctcccagcccacagactcgcacctcccccgtgcaggtggtttcctggcccactgtcctcagcccactcgctggcctttatctctgtttcacgtccaggaccccacgccctgtcggcgctgcttgggctacggtcactgtccacccggggcccacggaaacgcggtctctgtcccccaccgccgcttgccttgggaacgcggcccgaagcccaggacctggtagatgggcgcaggcgggcggtcggccgtgtcctcgccgcgggtcaccatcgcctcgcgcacggccgccagcccattgagcacgaccaccggcgtccaggccagctgcaggctgaacacgtccccgaagcggcgccgcaactgcagagggagggtcagggcctcttgtcaagccaggatcaccccagactacaggtcctagtcctatttgaaccttggacgacccccggggctaccaggagtgagcaggtggaaggaggagacccagcctcctgatcctggggcgggggtgggggtcacaccttctgtgatggaggaactcagtttggatgcgtcacccaggtatgaccttgcaagagtcaccaaaattgccgagaggccccagttagcatcccattcccagatgatggtccatgccggtgagcagtgaggcccgaggacccacagtgcaaaaggtttgaaccgggtcactgcacccccttcatcctcgatttcgtgatttaaacggcactcaggactaactcatcttccattcccaaggcctttccttctggtgtcagcagaagggactttgtactccataacatatgttgcccaatgggcttgcatgcccactgccaagtccagctccacctccaggcccttgccctactcttccttggcctttggaaaatccagtccttcatgccatgtataaatgtccttccccaggacgtcccccaaacctgcttccccttctcagcctggcttctgatccagcctgtggtttaacccaccacccatgtttgctggtggtggggcatcctcaggacctctgccgccctccaggacctcctccctcacctggtcgaagcagtatggtgtgttctggaagtccacatgcagcaaggttgcccagcccgggcagtggcaggggacctggcgggtagcgtgcagcccagcgttggtgccggtgcatcaggtccaccaggagcaggaagatggccactatcatggccaggggcaccagtgcttctagccccatggctgcctcactaccaactgggctcctctggacacacctggcacccccaccccaccaggcacagaggaccaggcaggacactctcggcacaccgagcgcgtgacccttcccttataaagggagctgatgatggccttcgccctctgctgtgagtgaacctgctgtgttgactgtgctgccagtggcagagtcaggccagggcaggtatgggctgctccagaggtccttgccgctgcttcctgctccaggcccttacccagggtagggtggtagaaaggcctggtcggagaagtcaccccctctccccactccaagctccccaagcccacacaggcttctgggataaccagggtctcagtggacccggccatccacctcccagctaggctcatacaccctaatgtagtcacaacccctcctccagaacatgaccttgccctttccctacccccacctgcccactccagagtgaccttcagcacccttatctgtcactggcacttacctggggccttagagctcctgatgatgagtggcatcatgggcctggtcccttcacttcaccttgcactcttgacatgcacagacgctatgcacacacctgatggtgcacagatctcttgtccactcccagacacttgtccacttgttcacacttgcagggacacgattacacatgcagaaaatcacccacacaaagacaatattcacacatacacagactcacactgacactcagggcacacattctctctcacacacaccagtcacacacacatacagacccggcaccaagtaccccacttcccagccatgcccgaggtttcctggatgggacctctcctgtccagaggctgctcccggtgagcctcaaagctgtcacatggatcccagctcagcccacattctgggctctggccgggccatgacttcctgtttgcaacagggctgttcccagagctcccagttggtagcctgaaggcccttgccccagcctgtgacagcatcctccagggctgcctgagggtcgtcattctccactgcttcctggcctccatgtttctgattagaaatctggtggaaacatta

SEQ ID NO: 46 - DNA, 6456 bp, Homo Sapiens
caagaatttcaagtcattatccctgtgcatgcaggcagtaccagtgccagcaataacaagtcagcttttctggcaaatccatcaaaattaaatcttaaacttttgaaaaaactaatatgtttattatgctcctgttagcttagaggcttaactatctgtgggggagggcctataattatgatcaattacttatgacttgaaggtacttataaaagcatctgcccttttaagaaaccattaaagaaccaggcttaagactgtaaaactaatcccaggggcaatagtaaatcacaggtttggggacccaactttgacaactctcccttggaaagaaaagaattgctgtcaactgtccttatttcctgaccctgtctgagcaaatattcgcagcctctaaaatccagaattcttagtctggccaagcaagtcatggggaccaatggttgtttcaaggcagaggcagaagagaagaaacaggaaggaaacaaaaagggaatgaagatctgtagctcatgagggtgacatcatcaataatttcctcaagtatcactgaatttcatggctcgtgactgagagtcttttctgacatcttacaggctaattatcctcaaggatcttcttggttccagagcctgtaatgtctgggtttgaatatgatttgttctacaaaaaaggtcaggtgaattgacccctccctgtgaagctgctccatggcaagagaccatcaatctgctgaaacgcaaacaatcctttagatatctgaagtactttcaaatttacaaagtgctttcacatacgccatctcattttattctcacgactttaacaggtaggtgccatcatcaccttaacacgtaaaaataattttagaaaacaatgcctttgtcttcagttcataagaatatcctcctgaaattcacagtacagaatccaagtcatgggtcagttagaaacgtctagaaacacatcaatctcaggaggataaatcaagagaataggatggatcagacaaaatctacaagcacaatggcagaaagtgtgcctctggtataagaatggcgtaagctttgtaaacaatagtgttatacaggggtgcctctgtagtacctctacgtttggaaggacactattcattcatatacatgataagcacccttaactggatactccataggtaacagacaaaataaaacaagaacttccgtcttaaaattgtagtggtggaattcatccttcgggatgtattaggtgattcccctaggacgacagctgagttacagggggctaaatataccctccccttttccctccaatatcacaaagagccccaaaaacggattttgttgtttttaacaaataaaatacacatgaaaaaaagtcatctataggtttttatatataatctcatcttctaaaacactcattctccttcactagctaggccgaggtataatgcggtcttaactttataaccatttactgccttatttatatatttatgattctttgatgccttctagcttgagtctaaactgcgttgggaacaaagcaccgcacaaatcaccagcctgggataagaggagacaagttaaaacctcccaagaagattctgtagatatttggtctctctgagtctgtagagagtttggtatttcaaaggtcagtcttgggtctctccactttgatgactaatgttaaattgtttgactttttacaaaaatatttagctgtgcttatttacatcatttcatcctcagcgcacacagtaggcatgtatttgttgaacagaagccctaaatggatgagaaaaaagatatttctgctacacattttctcaagatcgagaaaggtaaaatcacaacccaatttgcagaagtttctaggcattccttttcaatgtaaagctatgcatctctgtttaaaaaagaaaaggatgacacaaccaaacaatgtcaaccacacaatggggaaattccaggatcactaagaaaacaccattatcctaagtcacacattttcatttaatactggttaccacacaggagagagtaagaactgctgtctccccacccactcgcacaatccatctgggaaaagcatgggcagaacatttatgatctaaccataccacatcttggactcacatttaaccctttggagaattagtctaaagagtatgtccgcccagagatataaagtaaaacagacacagggataacagttttggaagaaatttttatgacgctgtttgagattgggcatcagcactcaaactccttagaccaccaggagtcattcttactacgcaactttaataaagagaaactgagagtatgactggcaaaaatattatgatgtttctgcatcttgttaacctgatttacacttggctccacccataaagttcccactgattatcacacggcatcctcattctccagtctcacctactctgtctttcaaaaattccccaacggcatggccacgaaaaatatgcgggggctagcggggcatgtctcaggttggcttatcctgtccctaaaacgcacccacttcccccagaccctccttcagggtgggcagggagaaaacgcttctaagttgcacagctgcagggaagcctgctcaggtcatgtttttttgacttgtctttcggctcgctgtctggcaaggtcaccggctctggctcgcggctctgtcgacaaaacttaactctcactctgtaagaccaacaggtcgcgcaggacctccccagtcgccctctgccccgcacctttctgggcctgaggattcccggctcggccctccccgcgcgcgcgaggccccagatggcgagggcgcagctccctggctcacctgaccacgttggggtgctcgaaggtctccaggtgcctcagcaccgccacctcgcggatggtggagagcggcatgccctcctcgccggtctgcacccgcacgcgcttcaacgccacgaaacggcctccgttcttcaagtcgcgggccttgaacaccttcccataggcgccctccccgatctccgccacgcattcgtactgctggtcagcgcggcacaggccgtccttctccatgccgcctggacgccgcccgccgcggcgccgctggggcgggcggggggtgcgctcaactagctggcggccgccgctcgcctactccggggctccccggagatcggtctagctttacttgctccccgccggctcaggcgctcgggcgctggggctttcgccgctgcagaagctggatggagagacctccccgcggggctggcgtaaccctggtgccgccgccgcgaaactccgcctgcagagtcgccgccgccgccgccgccggaggagcgagccgatccctcctcttccctcctcgaagcgaagtcctcaacacagacacgattacatagcctctgcccaagcgcgtctcagtccagaatcattgcacctaaaggaggagacgggaggataagaagaaagtgcaatcagacagcccagaagccttcctcggggttcctccagactcccctcctcctcctttacgaagcctccatcgctaccctccgcgcgctcctgccctctcccaagccgcttaatccttcctggttcctccgagaaaagcgaagttacttttctttccctgcagggctgaagccgtcttcgcgcggagaggttgcaggggcccctcggggatgagcgagcggcgcgggacgcagtggaacgggagggggcgtgccgagcagcccagagtgtgccgggagcgcgggggaggggaggcgccgggcacgtcaatgtcacggcttaatatttatccctatatcattgtgttgcgccgctaccctccccgcctcctgaggcccggacgtgcagggagacggggtccaggggtgccggagggcgttcaggggtcgcgcacaagctggagcggaaggactgtgggtccatccgtgtggggccgcagaatgtgggtgggggctcccaggaccctgtaacccgatgctgggagtgtgcgagaaggggtggtcagacatctgctcagaaattgcttcctttctttctactttcagtttttctacgaggagacatttaaaaacgactcgcatacacaaatggtctttttggggtaaaggagtctcggttggaaacggaattctctctccggctgggaggacctccctggtggaaaccttgggaagaccagccatctggtcggggagggttggggcttatcgggggtgggcgagcgagcggtcctgggggaggggagacaccgtcccccacgggatcccaagggtgggagaaaggggtgttcgccacaatttcgcttgtcgtctccttaaagaataacttcaggaaggggatagcataatcgcgcctcgtccttaagttttaaactgatttcgacctgagcaaaactcaacctccctttcaaagggtggggggtggggggttaaatcctgcgcctccaggggtgagagagaaggtctctgtcctcggggcccggactcgcgaaccttttcccattcccaggacctccccgctgtaggtagcagaggtggctgccccattccccctccggctaaaggcccggtccagtctgcagccggacgcccccggagccctctgcacaacaaagcgccagagtagggtaccctaactttccctccccattcagcagctatctgggacctagggggcctccctcctccagggccgccgcggcctcggcaggactttcaccacgacggccgcatgtccggaattcccggggcacctcggaattacctgcctcgcaaccgctggcccgctcgccttttgccaggaattaaacaaacggcgcgacccccacgatgagcgggtggagcggaccgcggcgagagcagagcttctggcactcactacattcagaactttccttaaaagccgaggaaagagcccccagggactgcccgggggtctgagccaggtcgagggccacacaggtagccggggagccgccgccggccgcccaacccgcctgtcctgcatccccccaaccccctcccgctcgagtctagccccgggctccgcagcgaaggaagcgtcggggacgtcccacccccgcagggaactgcgcctgctgcccccgccgggccccgcactgccctggctctccccccactcgccccccagacggtcggcttcggcggagagaaacgggagcagcaatgccttttccccccctctcctccacttttttttgttgttgttgttgctttcccacgctggctgaatgtgacttgaccccatttcaaaaaaagtttgacatagtgcttcaacatttccgcattcctccgcgactacaaaggctgcagccgcctccttctgctttctgtctctgctctctgtcttcacactcaatgaaatccttcatgcgcctctcccgaagcctgccaagcaccacaagggtcgccaccagcacagcgacaagaggccacaccggggaccgcgactcccgcgtgtgcgcacacgcagatgcgcccatatgcacacggacgggcgcgctgcggggaccagggctgctcactgcggggcgtgtgtttaactccaatattttaaattataaaagtaaacttggaaactacagcaaacgtgcgtcttcgcggggctccaagcctgggcactggccggctgcgtgcacttttctgtgtataacacgcccgcaggaagcctgcgttaacatttatctcgtggaggggaaggtggagcccacacccacacctcagcgagctggagagggagttttcgagggggaaatgcaagcacattctccagcatggagtccctagaggcagtgcattttaaaccctaaatgtgaattattatgtgagtgtccgagtagagttccagttccgtttggagaaactgtatgaggcgtgttccgtgtgggtgtgtgtgcgtacggatacgtggaagcaggatctcggtgtcgcgggtgtccctaggctgggatctccccctctcatcagataaggagaatcctctagctccccaaaactggcccccataaccaatcccgtctcagttcgtaaggggttaaccaaagccgattccaaggaaacacaggtcccccccaccccccgccaccctccacttaccccacccacagttctgcctcggaccccggccaatcccccagatctcccccgggaccccccaccccgcagcccacccacccgagcgcacagctcctcacctgaggggcccagtcgcgtcgggcctcccgagggggctgcgagtgtcagtcggctctccgcacgtgtccgcggcctcgcggagcaggtaatcagactctggggaaggagttaccagcactctctccggcgagggggtgggcacagcggcggagggcggagggacggcggagggcgccgcccgcgccgctcgctgggggcggacgggggccgct

SEQ ID NO: 47 - DNA, 4499 bp, Homo Sapiens
tttagaggccaccattcgaatcttggtcaactgtgaggaaaggctggaagaggagtttggagatggactgtggcaattctggaagacccatgtcctggaattcgagagaaagagaggaggccataccacctaggagagaggggctgctgaggtggggtgagctggaatctgctctcataagttattcctgccctttggcttccagggatttgggggcctttggtctttcctttcactctggcccaggatcaagtttctctttaacttctttttctgcacgtggattcccagacccagcctggtgctccagccagagcctaggccatagtggggagcgcgagtgaggagcatgtcctctgatgggtttttcagcgagggtcgaaaggcagatgctgaaaaggtgactcgcttagactcacgggaccagtcggggcagctctgggactcccagagttcccaaagacgatggtccaaaaaccaggagcagcgtgagcggctgccgagttccattccactcgtaagctctcgccaagtactgggcaggaaacatgatagccaagaggactggagcgttgactttttctcctgggagtgatacctgggacagccttcaaggctgaagggcccaggttctctccgtcgctcccacctggggacgtctcttctggctctccgccgccgcgcacacgcactagctgggcagcaggagaccagtcaatgagactgcaaacgttgtttgcttttatttatttatttttgagactgagtctcgctctgtcgcccaggctggagtgcagtggcgcgatctcgactcactgcaagctccgcctccagggtacacgccattctcctgcctcagcctcccgagtagctgggactacaggcgcccgccaccacgcccggctaatttttttctatttttagtagagacggggtttcaccgtgttagcgaggatggtctcgatctcctgacctcgttatccgccctcctcggcctcccaaagtgctgagattacaggcgtgagccaccgcgtccggcccgttgtttgcttttagttactgattgttaaaagattaagctgctggtaagccgacatcaataatccctccggaaaaatcttttaactaagttaataatagaaaaacattggttgcaattgtagatactagtcatttcgaagatgtgtgagagggaggtacagtgggtcccgggtaggctgcaggggtgtgtgcgcgcgaacgtgttgggtccgggagactgagagtgtgtgtgcaagatttcgggagggagctttttctccggggtgaggagtgcggactgcagctctcccaggccagcttccgcccaacactccccacaacccctaacccccaagccccgcacactcgccccgccccaggctggacagttactcccagggactcttcctcctgctttactcagaaggaggcagctgcgagccgggcgtggtggcgggcgcctgtaaccccagctactagggaggctgaggcaggagaactgcttgaacctgggaggcggaggttgcagtgattcaaaatcgcgccaatgcactccaccctgggcgacagaccgagactccgtctcaaaaacaaacaaacaaacaaacgaagtcgctgcgagcgtcccctcctctccttccctctgattagctgagctgcatcgatcaaggaccatccggcccgggcggcgggatagggagggcctgggcgagtccctcccggagccttggagtccgcaggagatttgcgggggcgggctgcgtctccaagagagcgagcgtctccaagagagcgagctccctgtcatgggcggtgtccacaaaatgcgcctctgtgggcgacagaggggtgcggtggggcctaggaggctcgtgggcgattccgagcaccgggtcggtcccgagtgaggggccagccctggggctgggaggaaggcgagaggcagcgccactgctcctgactccccgggcgactccacgaaggaaggcagagggctgagccccagcgcggatcagccaaactcgacgggcccttgccggtcacccgtccctaaccctggttgggctgggaggggtcttctcgcaagtcttctcgcccggcggaggcttctccttcccaacccccgcgacgggcgcatgccttaagctgctctcgcccgccgggctcgtctgtcgctcccagggcctggtggcccgcggtggcccgcgtccatcgtgtcggtcccaccgaccccgattaacgcaggttcgagatgcggcggcttccgccgagtgggcgcggcgttcggggtcctccgggagcaggtgcgaaggacgtgtctggagtctgtcgtctggacctctggcctctgggtgcgcagcaacccctcgcggcaggattgcaaccgcggaggcctgcagctgtgactaaactcgcgcctcctccgccggcttcgcggcccgcagtccacccgggctaatggtgtcaactttggattcctctcaatgccgggccctgtggcacccgggaaagtctccacgcaggaaggcccagggtcctgcgggtgtacacatgggaaggcacaaaagctacagatattgtttgttcaaattgaagctcggtggaaagctatgccttcttactttttaaaaaattcaactttgttgaagtacagtttacatgcaataaaatgcacccactttaagtggatatttagatacatattttgacacagtcacactccactaccatgatcaagatacagaacatttccatgtcctcaaaaattaccttgtgctgtcatcccagactaccctgtgtccctctactcaccccatcccacacacctgagttctaggcaaccgccggactgctttcttctactatagattatgtttttgtattttctggagtttcatatcaatggaatcatacactatgagctctgtgtctgactttcacttagcttaatgttgttgagacccctccctattgttggaaagatcagtagtttacctttttgtgtgtgagatggagtctcgctctgtcgcccaggctggagtgcagtggcgcgatctcagctcactgcaacctccgcctcctgggttcaagcgattctcgtgcctcagcctcccgagtagctgagattacaggcatccgccatcacacccggctaatttttgtatttctttaatagagacggggtttcaccatgttggccaggctggtctcgaacttctgacctcaggtgatccacccacctcggcctccctaagtgctgggattacaggtgtgagccaccgcgcccagcttttttattgctgatattgcattgtctggttgtaccgcaatttgtttaacctttctcttgtccatagacatttggactttttcccagtttgggctattttgaattaagctgttaggaatatttgttcaattctgtgtgactttatgatttcatttctcttgggtgcatatatagaaatggaattggtgggtcatatcagaaaatatatttttaatgttgtaagaaactgcaaaactattttctaaagtggctgaagcattttacactcccaccaatagtatatgaaagctccagtcatctccacatagccaccaatttttagtattgccagtctttttaattttagttatgctagtgggtgcccagtggtaccttactgtatttttaaatttcatttctcaaataactacgttgagcatcttatgacgtgttcgttttaaaaatgtgtatatcttatttagtgcaatgtctgttcaaatatttcactcatttttatcaggttatttgttttatattactgagctgtaaaagttttctatatatttaggatataactcccttatttatgttttgcatatattttctcacagtctgtggcttgcctcatcattttctttttctctctctttttttttttttttttttttttttgagacggagtttcactcttgttgcccaggctggagtgcaatggtgtgatctcagctcaccacaacctccgcctcccaggttcaagcgattctcctgcctcagcctcccaagtagctgggattatggtcacacaccaccatgcccggctgattttgtatttttagtagagatggggtttctccatgttggtcaggctggtcttgaacacttgacctcaggtgatccgcccgccttggcctaccaaagtgctgggattacaggcatgaagcaccacacccaggcttttttgttttgttttgttttgtttttgtttttgttttttcaagatagagtcttgctctgtcacccaggctggagggcagtggcatgatctcaggtcactgcaacctccacctcctgggttcaagcgattctcctgccttggcctccccagtagctgagattataggcgtgcgccaccatgcctggctaatttttgtgttttttagtagaaatggggttttgtcatgttggccaggctggtctcgaacttctgacc

SEQ ID NO: 48 - DNA, 4500 bp, Homo Sapiens
ccatgtgaggacacagggcaacgacagccatccacagccaaggaagagaggcctccaacagaaccaaccctgcccacacctggacctcaaactcccagccttcagaactgcgcgaggagaaacgcctgttgtttatgccacctggtctgtggcagaccaatacggctacttactagtcggctggccctgggcaggcttcctatgccctctgtgcctcagtttcctctactgtagaatgggatagcaatgtgcccacctcttgggctgtggtgagccggttaagatgtgaagagcctggagcaggctgagcaggggcactgcaaacctgctcctgttcttacacttccccacgactcagaggccggggacactgggcaccttgcttgcagctctcacgccagcttactcctaaacaccccaaccagagcccctacaaacacagccaaacggagcagaggcaggcagggtctgctcccgacagcccttgctaaggacgcccgaccaaggctggcaaggaaggtggctagggctcagagctcactgttttctgggaggagaaattaaaacataaatgaaaaagggctccggggctgagcagggcatggaggtggccaggacaggagcccagctgcaggtacagccccaatttatgtgatttttagggacctggaaagggacctggctcagcccacgtggcagtcacttctctaacttcctaactgcggccccaggatggctgctgggactcccagagatggactctcacggcttccaggggtgcaaaggaaggacagtgtggagtgtgctgtaagccccaaccgacactgcttgagcacctgctgtatactaagcgctttcatacagtgaaggcgaggctgcaggccatgtccagctcacagacagagacaccaaggccacccaggcaccaaggtgatgcagctaccgaggccacacgagaagcaagagggcatctctgtggcaggtgggtagtgggagttagtgtgagttggggagcggagacccaaagagctgtgctgggtggccagggaggctctgactcaatgcccagcaccaggtgagctgacctgggggtgcccatgtgtccacttatgggagaccaggaggcagaggcaggttgggatgagagtcctgggggtagagctggcccgggcggttcctcctcacagattctatagccggagatggagatggctcaggggcatgcctgcctgcggccctggctctccaagagctctgagaccaatgcccccggcttagcccaagccgcacaggaaagccatcctgtggaccaagtctgggcacacagagagggctggactccacacgcatctgtggcaggctcctggagactcctggaacacccctgcattctcccttcattctcaagcaatattcctttgggaaaatgctcacctggtctcagctgaatccaggaaattgattgccacccactcacacactcagagttcaactggggtggtagggacacatgcacaggaccgtgcccacgcctgggctgcatgcccgcagctgggggacacacacacagagtgacgtgcacccatcacttacacacacacattggtcacacacatgtccacactaaatcatttgctcacaaccactcacacacacactacctccacactcacaccctacagctgctgaggagggtgaggacaggtcgctactcccacctccctcataggatgagctgcaaaacggctcagaggcttcagcgagggtgcatgcgtgtccgccgagtgttccagcgtcccgggacagttctccccagcaccgttgatacagcccccactgccctctgaagtgcagacaaaacggagggcagctctgctcagggcctccctggccccaggaagggccaacaggcagcaagggctgccttccccaggaacgctccgctcgagtagtaagtgactgcctagctccggccccgggggattctcctgagatctgtgagtagatgaagctggggattagcagacatagctccaggccgggaggaaaaatccatgtgtgattcatgatgccctcccagacgtggggcgatgcaggtggcctggagccagggctgacgcctaggaccccaacatttctctgcacccaaggggtggacctgggggccatgcaggcactaaggcaaggcacgagcgtgtgagcgtgcagcagacagcatggcagtgtggtcccacctcaagctgcagggcagagcacgagagacccaacgtggtctctggatggggtctcaattatcctgtacggccaaggcctaagttctaagagctgggcagtcccccgtatgtggggcggtcacaagcctgcagctgtccctcctgctgtatatccatcccgagctcaccctggagcaggcctgggttcccggggcacccccatatcccacctgcccactctcaaacaactcttaggccagaaaactctctgagaagggacagcaggacttgggattcccccattcattcattcattcattcattcatttttttcttaataaacatcttggcgagcgtagtggctcatgcctgtaattccagcacttagggaggccaaggtgagtggatcatttgaggtcaggagttcgagaccagcctggtcaacatggtgaaaccttgtctctactagaaatacaaagattagccaggcatggtgacgcacacctgtaatcccaactacttaggaggctgaggcaggagaatcacttgaacccaggaggcagaggttgcaatgagctgagatcacaccattgtactccagtctcggcaacaagagcgagactccatctcaaaaaaaaaaaaaaaaacaaaaaagtctcgtgggctgggcacagtgctaactgctagcaacacccaggcaaggaagatgtctatctggtttttgcccaccaggaatttggaggttagaaacatagcccctctgcagataatctgtagcaggacagaaaacaaagcctggttatggtggggtcatccagcctgaggcactcaggggaggctccctggaggaggtggcccagctaaagccttgaaggatgcacaagagtgagtgagccaaggaaggggccggcacgagtcaagtcgcagagcccaggggacaggtcaggttggagaagggatgctgagaggccccatgaagcccgtcctctgctgccaatgaacccttcatggaggcctggaagcaccgcatggctccagcacacaccccgatcccatcacttccgtctccgcataccagctggggatgctgctccaggaagtgacctcaccttttaaatacaatgcgtcttcctgcaacttaaccccctcgggggtgtgtggaggcccggaagctggcctgcctgctcttgcagctggtggttgaagtgcccttgctcttccggttatggctcttccgttttttttttgtgtgtgtgtttttttgagacagggtctcactctgtcacccaggctggagtgcagtggcgcgatcttgtttcactgcaacctccgcctcccgggttcaagcgattctcctgcctcagcctcctgagtagatgggactacaggcgcataccatcacacccggctaatttttgtattttcctagagacggggtttcaccatgttggccaggctggtctcaaactcctgacctcttgatccgcctgcctcagcctcccaaaatgctgggattacaggtatgagccaccgtgcctggccacacccacactctgtggggaccagggcctcctgccacaatcaacccacaacagtcgaaggaggctatgaggccccagcgggacttttgggggacagggatgggaggaaattcaggactagacagattacaaaaccgctcacagacttctgcccccagctgcccctgctgagaattgggagccagaaaaaggaggccaaatctcagggtaatgttcatgctccttgtaacctctggtcccattaaactagcagcacaatcccagctttaccttgcagagccagacataatggggcattagaagggaattgaatttccctttaattacaatggcccacagacattgtttaatttgtaatctgggagttaatgtggttttctcctcttgcagtcatggggccgcctgcacacacatgttctcattcacccggacggagcatggggcccaccctgcaaggtgagacgtcggacaaggccgcccccagcccggtgagtggagtgccgcgcccagccctgcctctctcctgcctccagccaggcccaccacacagaggacgtcagtgtggctgtcacatgtcacatggagcacacatgcatggagccatcctaataggcaggcaggagcataatttttcctctaattacatattcagcacttctgagaaaatgagattttagtaattcaattggactgagaagcggggctataataaaatggaatttgtaacaatcgcgcagttaaattag

SEQ ID NO: 49 - DNA, 6499 bp, Homo Sapiens
tactgcatattctcacttataactggcagctaatcattgaatacacatagacataaatgtattttaacacattattattcccacttagattctgtgtaatatttaaccatttaattacatcaacaaataaaagcctttagaaattgatgtatctagcacaattaaggggtaatttgtttatgattacaggagtcatttcatttacactaatttgatgtgaggagacaatcaaattccttttttcctataagaaaaacttaattccgggaggcttaggcaggagaatctcttgaacccaggaggcagaagttgcagtgagccgagattgcaccattgcactccagcctgggcaacaagagtgaaactctgtctcaaaaaaataaataaataaaataaaataaaaagtaaaacttaaccctcacattttttctttaaaaacattacactattgaaatagaatagaattttggacctcaatgtttctatgctttttgacaatgtaaagattatatcaagaataacattgactccttgtgcacatgtgtgaaactatgtcgagctgatgtatccagaaaagaaattgcagcgatattgggtatagaatttccaatctcaacctccttcttgttgtggaatagaaatttagttccaccttctctgttcataatacataagagtagataatcagatatgaggtgattaaatatataaactgatttcacagttaccatggaaagaccataatatgtttggacgaggtgggggaaagagtctccctctgaactgagatttgaataggctttagatagactaaaaacccatggcctgtcttcttcaacttcccatcattgatcatctgggagaatcaaaatggcctggattataaagtgattacaattagtagggcaggcatactaaataaaaatggggtgagtgtgcttggatgggaaaaactggggtgcagagaaatatttcctgttttggaggcttcgttcatagcgagcctgaggatgcagatgatatggaacatgagccccaccaggatatacatcctcctgcacagtcttccctgatcagtgctgtctattgccctaggcaccatcctcagccactctgtgttaggcacttaggacagttctgttcaaagcatgattgctttctggtcagtgaagaaatagtaaagaaatgagagtctgcttttgaagcttttgtagcaacttaacatttctgcaatgtcgtggtacatgttttatattttttaaaagtattcatctgcagactagaaataaaagagtccttcagcacagatagtttgagagatgctactgtagagtgccctgggaggatgggattcttctagacattgacggctccctggagtggtgctggagcttgctgagatagggacgcggggattgctgtggaacagcatgttgtgaaaacaggcacagatgggctgttgccacgtactcagtatttggcaggcccaggcaccctgccccggggagacagagcaacagctgtcatttccaaaaatgtgacacaaatatgactttcgttttttattgtatgtgtatgcatgtgtgcatgcgcatgtgtggttggtgtgtgggtaaataatattggtgagggagttagcagtgcagagacgcagagatgaatctaatgaatttatatttggaggcccttgaaaggagccctgtgcatgcataatcaggaagcagaagtgcagtcgtaggccagtcccatcctctggtggaaacagcaaattacagccttagcacttctcacctgtagcaaaagaaatgtatgctgcacctgggaggggtaggagaacttcttagaatttggtgggtttattagtcagggttgtgtagagaaacagaaccaatgagataaatatgttagatagatgatagatagatagatagatagatagatagatagatagatagatagagatgatagatgatatagatagatgatagatgatagataatagatgatacatagatagatatagcaaatagatctatagatatgacagagagagaatgagagagatttacattaaagaattggctcacatgattgtgggggctgcaaatcctacatctgtagaatttgctggcaggatggaaattcaggtaagagtggatattgtagccttgagtcgaaagtccacagggcagcaagctggaaactcaggcaaggtttctaggttgcagtcttaagaagaatttcatattctttaggaaacctcagtctgtgttcttagggtcttcaactgattgaatgaagcacaaacattatggaaggaaatccggtttactcaaagtctgctggattaagcattaatcccaactaaaaaacgccttcacagcaacatttagactactgttcagccaagtatctgggcaccatagctcagataagttgacgtataaaattcaccatcacaagggaggaatttatatatacactttattgcagcaaaatctttacagtttaacgttttgtacttttcccagaaggaaacgtttcagtgcagagttgaatatcgcatctttccgtagctcatacaaatcccatacaactttgatttgctgagcctctcctgaaaactggacaacttaagtgttcatgaaaggttttaattgcttaagaaaatagactgtttgtgtgaattacaaagaaaaagggattttagaaggaacattggtactccgggaagcaggttggggcaaggcttgcataagtgaatcagaagttttaggcacgaagtcagcacctctgtcatggcctatgtcagttgagtctttacctttgcctcgtgcctggccttcagaccctgtgagcccgctccgggacagggttacggccaatccagcagagattctggcaaagcatcccgggaatgagagtgagaaaggcccaaagcagtcaaggcccaaagacaaccctcgaccccatctctccaaatgtcagccctcaagatctcaggctctctggacctcaatctccatgccacttcaaaggccccaaatttcagccccagcagctccagctcatagccctaggtcttcagagatcactccagtaactcccaaatatcaccccagggatccagttctgacagccaagaccactcctctcataaaataatcgcagatattaggtgaagatccccaaagccccaaggaaaccctaaatctcatcctgaggacaccgatcccaccaaagccccgaggaaaccccaaatttcatctcgaggacaccagtcccaccgttaggaaccgggacctcaacccacagcacccggattccgagaacagaggcttcggggccaaatgggctgaatccagtacctcactcccacgcccccgggtggacagcaaccctcctccaccgcgtcccctcgtgggttttaggtcctatatttgagggatgtggcctcctccttttatatcatgttggccaagaatgatctacacagtcatcatggaatattgcatggagataaggagtggctgtgcccctgcctgaagggctcatcccattcatgaggcaggatgaccctcaaggcagtgctactcactagagtcaaagctcaggtaaggtgtttaggggccagttgcaacatgaagcacattagccaaggcagtctcaaagagtattgccagaggaagaatctacacctggctgtttaatgaggttgaaaggcaaatctaggtcaagcaggccaagtaaagaggtcagcccagcactttgggaggcagaggcaggtggatcacctgaggtcaggagttcgagaccagcctggccaacatggtgaaaccttgtctttactaaaaatacaaaaattagctgggtgtggtggcacgcgcctgtaatcccagctattcaggaggctgaggcaggagaattgcttgaaccagggaggcggaggttgtggtgagccaagatcaggccactgcactccagcctgggtgacagagtgaaactccgcctcaaaaaataaataaataaataaataaaaataaaaaagaagtcagaaagcccatgaaaaacatttggagggaagaagttagtccaagaataaaagcattaggtcagggcgtctaagatccccaaggattggtcctggctgtgtagacacttaaagagattgtgcaaggctggacaggagggtgagctggccaaaaaggtgatctgctaactgtggaatcaaccaccgcccaatgtcctggataactgagtctgactcgcaatggttaggcttaccattgtaaatcagtcttgaagtataaacaagttcattaaactacccctcctgtttacattttcttttattccctgattcatgtaatctctgtagctcatatctaaataaaaaataataacatggacttgttattatgcatgtcgtggtttacttctaactgtaaagtttctgattattctcctgtcatgctgatcttcatgtcagaagaaaacgctttgctattcaccatgagtgcagaaaactgcttactagaaacgattctaaacagcaaaggatgtatatttgaaataatagggttgtaatgaaaaagtacatatttctcaatctcattcaatacattgtacccgtagagtaaaagatatagaaaagcatcttatgttttaaaaatgtaagtctgagagtgaaaaacagagacaataaaaacctttctctaaatattattggtggaaaagtctcaaagcaatagaaagtatatataaaatgcctgtgaatttttgtgcaataaaatcatatatatatatgtgtgtgtgtatgtatatttgttttttttgttttgttttgtttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagcggggttggtctcgatctcctgacctcgtgatctgcccgcctcggcctcccaaagtgctgggattacaggcgtgagccaccgcgcccggccaatgtatgtatatttgtaactcagatttgtaaatgcagccacattcatatccacacatcaaatgcaccaaaaagattcactaagttcctcatagtcagtccataaattcccagcttcttcacatattcgcattttttgtcttaacatgatataatagttaaaaaaatttaaaaattaataattaaccaagtttttttttcttgtagactatatcagccattattcagaaacattaattcattgttttaaaaataatttctctagagatgtttggcacttagtatatgaaatcatttataattgaataatacaaacaaaacagaaaaaagaacttacttttgggacatctgaagaaagtgacctacaaactcagtttatccctgagtctcattatttttaggaaaatggtctctatgtcatctctatgttatgtttgacttgtcttgcttgagtctgttttccagaaagattgtgatccttggcctgttgaatatgaaatttacatgatcactcttgggaaaaattccttttttagtgactgcaagccaggtcctgtggccgagaagcatcagctgtacttggttgactgactgtattactctgttttcatgctgctcataaagacatacctgagacttggcaatttacaaaagaggtttaacagactcacagtgtcaagtgggtgggggtgcctcacaatcatggcggaaggtgaaaggcatgtctcacatggtggcagacaagagaagagagcttgcgcaggaaaatttcctcttataaaaccatcagacctcatgagacttactcactatcacaagaatagcacgggaaggacccacccccatgattcaattacctccaaccaggaccctccacaacatgtgggaattatgggaactacaattcaagataagatttgggtgaggtcacagccaaccatatcactgactttcatcatattataaagaactatcttgcagagagaatctgctttccatctctaataatttgtttattctggatatttcacataaatagagttatataatatttgttgctggctttttcatttagtgtaatgttttcaaggttcatctgtgttagagtatgtacctttgcttcattcctttacatcactaaataatattcgattgtatggatgtgccacattttatttgatctcttatcagttgacagactgttgggtttttctactttttggctattacgaatgatggtactatatgaacattcacacacaagttttcatgggtatatgtttttatctttcttgggtatatacctaggtgggggattgctgtcatatggtaactttatgtttaacatcctgagga

SEQ ID NO: 50 - DNA, 4441 bp, Homo Sapiens
ctagtacaaggtctttgttaagttcatggcctgaaaattctgtttccttccggatttgaaagtaccttggtttccggatagtatagaaaaatcaaacagttagaaattgaataattacagcacaatccaggaggtttgccagcttgactgagttctatcaattttttaaccgtaagaaggaataaaatatacttgctggcttttatgccgtggtctgtttcagagtagtcacctaagtccacacctcatgtcagaatgagaagtgaatcatctggggacaaacgaggtgtgtatctgcctaacagcttagtgactttctggaatttaaatattaagtgaaaggacagggtcacagggcagctgatctttggctcgtctctctttcgtctgcccatggctttgatcatgctacatcctcctttgtggccagggctccacagagaatctcagggtcatggcctgttgcctagtcaagaggtataaacctgctgcttaaatatgtgaagcccacagtttgggggttgggagttaaaggggaggtagcctcatacgttccacttttcccacaaaacccaaagcagactaaacaaaaccggtgtgaaatctcatgacttgatgctgccgtggttatatttttcaagctgtaatccattcatttgtatgtgtgtttattcccaggatttacagctcgctcagtcttcggggggaaagagaatatttgaaaccttttgcaaagggtttgaagtatgcagtggcctgtgattaaagcccaggatagagtgtgtgtgtgtgtgtgtgtatgtgtgtgtgtgtgcattcatgtgaatgtgtgagtgcccattcttgtggggtttttttctcccatttgctgcttttacgcaaaagcatcacacatggtagcatttaggagccccttcacagctgaagtgtttcaaacactaatgaatggaagtttggtcatataatgcagacaagctttaaggcatgctttactgaatggtgtactgtagtgacctgggaaaggaagagaggtataaattgtgtcggttagccacccagacaaaatgaagccatgtggaaaatcaaatctattaaagtatgaagactgttataagctgttttaagctggccattcttaaaggggctcggtctgctgcaggagtaaatgtttacctcttcccccagatctttttcacatgccgtcttatgagacaatgtgcagcatttgataaaaatcatcctctcactaacgacgcttttatcggaaatgtttattgtctccgctttaccacccatgtcctgaaaggtactgcacatttgttaaataagcaaaaggaaagagaactttgcggctcaagccggctcgcagaaaccccaacaaattccagagccataaggaatcagaaaaaggaaaagggaaggaggagttagatttatatgaagagggggccttgcaaaaacatatatattagattttctctgcttggctagcccaccatcaaatgtttggtcgatgcggattagtattgagattgagcagttaacgccgaacttgggtcactgtctcaaaatgtgctttaataaatacaagggggaggaaatggatttgggaaggctcgttgtcagctctgcccctgctctcacactgcctctgcacagtggtgtaggggtcacacacaggtgttggcaccagtaccaacccgacccaaatcctggtcccacacaccctgtaattttgggcacattacttgtctgtgccttggttttctcagatgtaaaacaggaatattaacagaaggtgcctaagcatctggtaagcactctaaaaataccagctattattaccagtatctggagggtgggttcatttataccttaagaaaggatccccctaactctatttttcttgtgtgccggtttttaaaactgatgaatggcatgctgtcgggaaaaatttatccattcctactttttttctaattggtgagtaagcgtgcattgccctgacattctctggacagcaaacaattgaatttgctgaccagccgccatgatgtcaagccttaagtcaacagtggctaatgaccgctctgggaaaaaacaacaccttgattcctcaattacggtttaagaagccctgggaatgagggctcgccagtcatcgtcatcctcttttgaggcaagcataatgtgctgtggaaacaggttacctctgcactgttggcaagagcagcccacacagtataacgattgagcgtcatggctgtgccctttgtgtgttccaggaggaaactgaagagacatcctcacaagagtctgccgaagaggactagggggcgccaacgttcgatttctacctcagcagcagttggatcttttgaagggagaagacactgcagtgaccacttattctgtattgccatggtctttccactttcatctggggtggggtggggtggggtgggggaggggggggtggggtggggagaaatcacataaccttaaaaaggactatattaatcaccttctttgtaatcccttcacagtcccaggtttagtgaaaaactgctgtaaacacaggggacacagcttaacaatgcaacttttaattactgttttcttttttcttaacctactaatagtttgttgatctgataagcaagagtgggcgggtgagaaaaaccgaattgggtttagtcaatcactgcactgcatgcaaacaagaaacgtgtcacacttgtgacgtcgggcattcatataggaagaacgcggtgtgtaacactgtgtacacctcaaataccaccccaacccactccctgtagtgaatcctctgtttagaacaccaaagataaggactagatactactttctctttttcgtataatcttgtagacacttacttgatgatttttaactttttatttctaaatgagacgaaatgctgatgtatcctttcattcagctaacaaactagaaaaggttatgttcatttttcaaaaagggaagtaagcaaacaaatattgccaactcttctatttatggatatcacacatatcagcaggagtaataaatttactcacagcacttgttttcaggacaacacttcattttcaggaaatctacttcctacagagccaaaatgccatttagcaataaataacacttgtcagcctcagagcatttaaggaaactagacaagtaaaattatcctctttgtaatttaatgaaaaggtacaacagaataatgcatgatgaactcacctaattatgaggtgggaggagcgaaatctaaatttcttttgctatagttatacatcaatttaaaaagcaaaaaaaaaaaaggggggggcaatctctctctgtgtctttctctctctctcttcctctccctctctcttttcattgtgtatcagtttccatgaaagacctgaataccacttacctcaaattaagcatatgtgttacttcaagtaatacgttttgacataagatggttgaccaaggtgcttttcttcggcttgagttcaccatctcttcattcaaactgcacttttagccagagatgcaatatatccccactactcaatactacctctgaatgttacaacgaatttacagtctagtacttattacatgctgctatacacaagcaatgcaagaaaaaaacttactgggtaggtgattctaatcatctgcagttctttttgtacacttaattacagttaaagaagcaatctccttactgtgtttcagcatgactatgtatttttctatgtttttttaattaaaaatttttaaaatacttgtttcagcttctctgctagatttctacattaacttgaaaattttttaaccaagtcgctcctaggttcttaaggataattttcctcaatcacactacacatcacacaagatttgactgtaatatttaaatattaccctccaagtctgtacctcaaatgaattctttaaggagatggactaattgacttgcaaagacctacctccagacttcaaaaggaatgaacttgttacttgcagcattcatttgttttttcaatgtttgaaatagttcaaactgcagctaaccctagtcaaaactatttttgtaaaagacatttgatagaaaggaacacgtttttacatacttttgcaaaataagtaaataataaataaaataaaagccaaccttcaaagaaacttgaagctttgtaggtgagatgcaacaagccctgcttttgcataatgcaatcaaaaatatgtgtttttaagattagttgaatataagaaaatgcttgacaaatattttcatgtattttacacaaatgtgatttttgtaatatgtctcaaccagatttattttaaacgcttcttatgtagagtttttatgcctttctctcctagtgagtgtgctgactttttaacatggtattatcaactg

SEQ ID NO: 51 - DNA, 4343 bp, Homo Sapiens
ctcaaagaactaccaaattattccctgggcccctgaatcagatggagctgaatcattctggctgctaactgagtgaagggtgttggggaaaagtgccattgtgtaagttaaggaaagggtcagagaaccgaaaagacggcagctgtatgaaagggcttctgtgctgggattctccttttaagctatccaaaggcacaaatcaagaaccgcaaccttggagatatgacaaatgaacacaattctggttttttgttttattttaaagtgaaattccactgtttcccaagaatttgcacatgaagctttacatatttttcatgtcagcccccttccttgccacctttgttttccagcctgcctccccttaacagctggacacatcaccgttccatttttctattagttgtgactgaagtagcttgaggtcaattatttccccagcaattgacaaagaatcttgatgaagaggaaagtgacattgtcccttgaacaacactgctccctcctccccctgccctcccggctgagaggagagagcagggcagactttccttttgcaaggagcccagcagggcggtggcggtggggtctgtggaagtgcgtgggtaacatatggtaagtggagaaaatatttatattcatggtgaaagagcaggagaagatccaaagaaggtcattccacagagatttcaagcaagagacactgacttgatattgtatctttgacctggatacaacagagaatttaaagaaagagttttcttttgtggctttcctgccaccgttacttccaacaatccgaattattggcaatttaaaaaagaaaagattccgcccactaaacttgataaaagtatcacactggcccttccccgggccctggccaggctgccacgccttctcccctccccctgcgccaggtccccaaatccagaattcggagccgcggtcactgagcctgtgccttgggcctgcgggcggtgtttgttgttgtgactgggcggctaggtgagacggagcgcacgggcagagtgcgcatttggggcgactggttcttgggggaagatataaataatgaatcggtgttagattattttctgatgagacacatgaaacctccagtgctttcagcaggcattttgcatcacagcttcctaagaaaggtaaaaggccctctttcggtcccccagtggcaaaattcgcagctgtcgcccagcaccacaatcaaatgcgtgcggggctgcgggacagaggcgtcctcgcgtaccctcggacagacccacagctgtctggcggatacacacgtgcgcgtctggtcgaccggaccagcagctgcttgcgtcccctctcccgcgcacggtggcggccccgcaccaagacccgctgaggaaacgaagagtagggtcatttcccatcttgccgtcgaaagtttatcccatttcccgggtgtgcaggaagagatggcgcgagggcaggaaggtgtgaaactggggttctgcgggagacccaccgtggctctatattcactctcgtttgaaaactgccagcgttccactccccctaaattccagttcccgagggggaggtagtgagatgggatacaggtgcgtctgggtcctcgcttgggaggggttctcccactttgggacccctcgtggagcagcccataaccgaccggcctgctgtacagaggccatgcttaatggattctcgcagataaaagggcctggctacctttctttcctataatggcccctgaggctaatgtcttaaagaggaaacaaagggattgttttacagcacacaaggggggtggcgggaggaacagggagaggaggaggaaggggcattggatacgcggagcgggaggaggcctcccgcttcttaacccttcacctcctgcgaccgcccaggtctcccgagctccgcaccctcatccaggacccgaaacagcggggaggaggcgacagtgcgtggagggccccgccctgtgactcgacctccagctctcctcacctccttccccgtctttttaaagaacttctgaaagggagaacggaaaagatgaggggacccatatctcgtgagctgcagttctgaaaagtcagttctagaggggtcgtctctcgcgaggcccgggtgcccacacaggatcgacgcgtggcagtgccacctgggcccggactctgggactgcgggaggcgggagcgcctggggccaggacctgggcgtacgctgagggcacccggtgaaggccggggaaagtggggcagctccgaaatgcggcctgcacgtcgccctgggagtcgttcccgggcccctctgcagacacagccttcaggtgtgagcggtgtgtgcgccggccgggggcgtctcttacaggaagtttatatttgcaaactgggcggtgggggggggggggggcggggcgcggcgggagagagagagtctcagtggcttctgctttctggcttttctgttctggctccaggaaaagatcaaaacaatagttaaatagcaattgaagacaagtgatgtaagaaataaacaactcgacaacaaaaatgcccatagggacggttttttaaaaccctttattatggaaatcagagcacatgcacaaaaggagagagaaaggtattgtgcagtgggtctcaaatttgatcaagcatccgaaccgcggagcgaaatcctctggagggcttgttaaaacacagattgctgggccctagccctagagttttttgttgtgtatttttaagcagatctggggtcagctccctcctgagaatttgcaacttgttagagccctcaggtggtgctgcttctggtttggaaaggacactgctatccactggtccaataaatctccgcgtaccctctcccaccttcaatatgtacaacacctccccactctgttcattctatcccctcccacattttgtttggtttgctggagaattataaagcaattcccagccatcctatcatttcacctatatagatgatttttgattcggtggttacttaagccgagaggactgcaggcttccttgtggtcatttcacattggggcagaatctggtacctctctctgggaaatccatgcccatatcttggttctgagaccacccttcgggagttcctttccagcagattgtcacatgcccaaacatcaccactgggtctgctggcaagctggcctggcctggtcagggcaccacctggtccccatctttcattttctgctcattgtccccaatctgtcatcatgtactcccacaaccatcgtttcccctgaggtattttcctaacaaggcgtctcccctccagggtggagttctgagtgcctagggatggggtggtacccacaacagtgcaagcccataggattatttgcatcagttaggtccaggactcacaccccaaggggagcttctctgggctacttgaccctccgcataattcctgattggaaaaggggacattctaggcatagcttctgggaatggccatcactgacatctgtcgtaacctcccttgattgtcgggccctagctcagtctggctatctgtgttgcttctgttccagagaggtgccaagtgctctcttagactccacctggctagtcctaagtgtgcagcctctacctatctccttgcctctcctttgggccgctccgaaacaagcttcccttctttccctcccctcccctccccatcctggtttaggataccatctgctccttccacagctttctcatcccagcccctcccagtcctatccccacctcaaccctcagaggtctcttgggctgttacaaagtttagacatttttttttattttttaaacttttagagatggggtgtcacttactgtgtcacctaggctggagtgcagtggtgcgaattcggctcactgcagcctcaacctcccagacgcaagcgatcctcccacctcagcccctaagtcactgggactacaggcacgcaccacataggcctgttaattgttgtatttttttttttttttgtagagacagggttttgccctgttgcccaggctggtcttgaactcctgagctcaggcaatccgcctgccttggcctctcaaagtgctgggattacaggcatgagccactgtgcccgacctagactcttttattgttctctttcttttcctgactcttcatgaagcaagcatactatatgaattcttcatttttccatctgctgttaaagaaagccccggggatggagtaggttcctccaccccagagctctgttcctattttcatattgcctcatcttcctatgtttttcttccttcaccagcctggaa

SEQ ID NO: 52 - DNA, 4476 bp, Homo Sapiens
cctctaattcttactctaagaagactcagagtaacaacgcagaaaataagcggcctgaggaggaccgggagtcagggcggaaagccagcagcacagccaaggtgcctgccagccccctgcccggtctggagaggaagaagaccaccccaaccccctccacggtgagccgcaccccccgctctctccttccttcctgcggtggggcctgccctctccaggcagctcttctcttaattcagactctgttccctttggctactacttctgcttatagcaggaagcctcgctcccagcagtaaatgcagaatcctttccttaacctaccactgtctgcttcaggtggaagggacaggaagcctgttccatgaacctggggggagaacctggctgtagaccactttggctttctgatagaacgcttgccctttattccccacagaacagcgtcctctccaccagcacaaatcgaagcaggaattccccacttttggagcgggccagcctcggccaggcctccatccagaatggcaaagacaggtgagagacccgggccctgcctgcctcactccctaggagccatgtctcacagggtgatgtctgtcagcagcaccgtctcctgtccctgccagcgcattgctccctgctccctggagttccatcctggctgtgtccagtccagctttcccctcccctattccacgccattgcctcctccccatcttcctctgactgctacttgcagtttgccaagtgtggggctgaccgtggccatctcagctacatgctcgcttcttgaccacggccagggcatggcagctgccctcctctagacatgagcagctaaggccttgtgttgggggtcccagctcagggcagaaccaagagatgcccaccttgaggggtgtacacatagagggcgactccagccatccccatgagaccagagctccccagccttcaccggccgcatttcttggtgttgcattcctggctctatctcttctgagtttatgaaagtttcccctcagcaacaccccactctttctgtagaagaaactctcctgttcttaaaattcttaggaggccagtgcagcctggaggcagcggccccttgtctgctctccttcatttctgattcctcttcccaggcactgacccacctcgctgcttcccgacctcactcacctccacttctcagccccgcattcctcagttctgacttgcatcccgctgctgcccaggcctgacttctaccctgccagagctccccagctctggcccttcccctgcccttgcttcctaatccaggcctcccgccctcactcacccctaacacgggcctctccgctgcttttgtttcctagcctaaccatgccagggtcccgggcctccacggcttctgcttctgccgcagtctctgcggcccggccccgccagcaccagaaatccatgtcggcctccgtgcaccccaacaaggcctctgggctgccccccacggagagtaactgtgaggtgccgcggcccaggcaagtgtgctggggcagctggtgcacctgctgccctcagcccaccctacccccttgccccaacaatttcttcttcccacttgggggtcctgctgtgttcttgtcatcttagccacaagaaatgggtctgtcccctgcggccaggaagtggagggaacaaaaaagagcattaatgcccctcttttccagttctccctctcagaacaggtatgcaggaagctgtcctaaggctccaaagggaaacctttttgttctgaaccttccagggtttccttagggaccccggggatagtcggcatcacagggactcaatcctcaagggttggtccccattgccgccttgagggtccagtctgcccggctcccagggagcccgctgtctccagcctaaaccacactccacacaggggtccttccttgcctccctccctcccttcccaaaccatctccttccacttccacgagacttccttctcaccactgtcctcagtagtcacacccttccttctgtgtcctcgtgatggctgcctctgccctagcatccccctccctgtccccaccacagggtgtccaggtgcccagtgatggctgtcctgtaccctaattcgtccccctcaaccccacttctcttcccacagcacagccccccagcgtgtccctgttgcctccccatccgcccacaacatcagcagcagtggtggagccccagaccgaactaacttcccccggggtgtgtccagccgaagcaccttccatgctgggcagctccgacaggtgcgggaccagcagaatttgccctacggtgtgaccccagcctctccctctggccacagccagggccggcggggggcctctgggagcatcttcagcaagttcacctccaagtttgtacgcaggtaagcaaggagctttgggtggcagagaggctcaggccaggccttcctgctttactcggggtgggttgggggttgggggttggggtttgggacactctgtaccggtattgggtcctggggttagaagaggcttcaggaagcacaagaaattaggtctttgtcaacaccttatgtgcccaggcccacccctcttaggcctctccccaactcctcacaggcacccctcattctctggccccaagcagatggccgatgccgcctcctctctaggagagtgtgaactcagatgctaaaataaaagcccccccttctctcctgggttcccatggaaacttatatttggtgacgcagctgcaaagtcatgaggcatgagccaggctggggccagcaaggaaaattttgtcctggtctcttgcccctttgactgcctctcccactagttggttctgtttctggctgcaggcgcagccatgcccttctgcccgggggttttagggtgaaacctataaatgaaatcactggcgagggcctacagtggcctcttccctaacctaactccgatgtgccaaaggtttcctgtgttggacccagggtggggatctcttcacggggtttctcacacctgagcccccagccaccacagaggtgcagcttgaagtgcatccagccaactggctggcctcctgggatgctccgcatccccatcctgccattcctctccctgccttggagtagcagctcaggaagcagcaggggctttgagagaacaggctcgcctgcccttcctctacgtttcactccactctgctggaggagccaaagccactgccccatccgagccccagaatgcaagtgtgaggcctgcagagagtgtgggcaggtctgaaagcctgggactctagtctcgctgagcggctcttccgaaaatgggatgacccttgaacctgtaaagccacctcccccacctgcttatccacataccgtcttgttggttttttttttatttctttttttattttgtcttttttttgtttgtttttttagaaatctgtctttcaggtttgccagaaggtaggcgttgagcccgctgtgtgtgtgtgtgtgtgtgtgtgtctgtgtcctgtgtcctgcctccatcactaactccccttttctggctcttactctcctccatctgcttaaccaagtctgtgtggccctcctctctctgccatcttaaagggatgaagactgcctctgattgggcatcagcacaaggcctgccctccgtgcccccagtacaaacaggcagggctaagaggccacattggcccactcagggcaaatggctttaaaaatgagggccttccttgggcccacagttaacgcctgtcctcaagtaaggggagactgtctcagggaagcctccctttaagattgtctcctctcacccaccccaccccacccccactccctctcaccccaggttttggtcacaagtgttgggatcctttcctgccctttcccttgtcatgtgcatgcgctatgaggaagctccagggttacaagtgcatctgggatggtatcttgtttgttgtctcctgggtttcctgaacttcagagctatgtgacctcttccccgtggcctatgggatcgcaggactttggagacactacggggaccctggggccccaaggtttcagtctggctcccccagaccttaggagcttttgtctcacaaatggagcacagcaccccctcctggcagctcctgcagaactagccccacccacccgcacccctgccccagcacccctgccaccagcagcatctggataaatcaagcctcttctcctctaggctgttttctccagatatggcctgtctcttccaaagtgcggggagctgggacattctagggcaacggccattctaccccaagccgtagcaaaacaacaggagatctctgcacccttactcaggggtctcccttcacagtccccttcctggctctttcacccctggccttatgctcatcctctctgcaggcctcggggaccaaataccaagctga

SEQ ID NO: 53 - DNA, 6435 bp, Homo Sapiens
attttctctcctactttctcacagtccctgaacctgtgggatagactgtggtagtaatggtaaatcgatttgcaactagtttcaggtgtacacacacacacacacagcctgtcacactctcccagtcacagccattcgtttttctcagtctttgctgcagtctctcacgcctgctttcgtacacacaattgcaccttcttgtatctttggtctcggtcactggtttggtctcccagccattctctcccgtacaatcaagttcgcacccatacagtcttacagctttagctgacactacagcctcaagtaaacagttttgcacatcatctatttctcaaacgttgagtcgcctacagtgaggtttgtcacctacacaatctttgccacaatccctgacaacctctactgtagtttcatgcccacgtagtctctcacatgtggttttggtcacccagtctgtcttgctcgccatcaaacagtgacagggctgcagtccccgttcccttctcgtagacattattttgtgcataccatcacaggttcttgtacagtaccttgactattcatccaggctcagttattttctgaaacacagccacaatttcccacatagacacaccatcaaaagtctgtggtcacaacttctgcacactctcacacacaatcacagctttccacgtctctgacacacacatggttaccgatatgcagtccctactattgtttctcacacacgccatcacaccgtttctctcacaatcgacctctgcctcacaccctccacacacagtcatgcgtgtcacgctcagctagtcctgacaacatcagagaaaaagtgccagcagcctccagcatcactttgaaaaatatatatttacaggaacaattccccattctctgggactctttagaaaaaaaaaaggtccattttggggaagtaaaacaaacagtggagacgagtgtagcactgtcccccaaatcaccaacccccaggtcccaaggcctgggctgggccagcgctaacaggtgagcccaggagtcttttgaacccactctctcttgcctagaatagagacaggacaggctttatgtcccccattcctccctcccaactccagggacattgaaagggtcctttgtacccgcccgcaggaaattggggggctgggagggagggaactgaaaattcatgtttggtatcaaaaataaacacttggagtgggggaggcggcaggaagattcccccccaaatcccttccttcccacccaccccaccaaatataggaagagatgactccctctcccctattgaaaagccccatttaaaaatagattatactatcaaaatggcagcgggggagagacagggagacctggagtactggctggaggggccccccagacggggaccaccccccaaaaaaaccctccattgggaggaaacaggcaggaccccagggaggttggcagacaaaggaatggcttctcagggggaagaacaaaagggacattcctccctggccaaaaagttggttgaaaaggataagctgtctgagagaaaggttggggaggtggaaatttctattccaagggtgtgattcttccttggccaagactcccaacccattaaatggtacaaattcttcctggacccctgagtatggccaggaataataaaacaaaacaaactaactcttctactcacatccaaaaacgcagacagggctccctcatctccccaagggcaggctgagaaataaagaaagaaaggtcgttctcaagccagacctcgattgtcttgtcttggggaaaaaagtggggaggtgggggagatgtcctaaccaccctaaaaggttaggtcaggctcctcccagtggccttcaaaaaataaataaataaaccgcccctaccattgaagtaggagacgtgtaagggcggccactgggggactgacagaaaacagagaagttgtggaagctgtgtgttttctgtggaggagataatgagagttactcttgggagtaattcttcccaaggatccccaccccaccacaatcagagcatgagtctttcagttgaactatgtttctccttgagatggctggctggagagagcatggatggagtgaccccagaaggggtggtggtggtggtggtagtagtcatggcttctggggccctggggagagcaccacgggggtcgagaggccatccacgctgatagaagggatgtgcacctgggcgctgccactggatggaaactgggggcaaaaagagggagaggtcacagatgggggccattcttgggtctctcaccctgtccaaaacggggaaagaggatcctacctggaaggagagcttggccgggctacggggcgcaatgggactcagggtgctccagaagtgaatgctaggaggcagcgagctgggtgtcagcagcaccggggtctgtggggagagggtggtcggagctcaagtgagtagaaagtagatgtgggatgctggaagggacttggtcccggccccaccacagatttcccactcacactcccagggtcactccccaaagtgcacacacctagatggtaaccatggaggccatgcctatgatctctcaaactctgcagacaccccccactccccactcccgagagcccaccctcagttgctgagacctcattggtcaagaccacccacaagaccctatccaaatgctgctctcaaacctctcaagtcaccatcccaacagctcagggtcaacttccaactcatgtcccacccatgaaaccccatatgcacatcccagaccaaaaagccctgctcaggttccttaagccacaccccaacctagaaacagtcccacagaaagaccctcggtcccacccacaaaagtccccagccctgcccttcactaatcaaaccccatccctccagccagcatcagcccagtcaatcacactcaaaggctccaccctcttcaggaacaaccacactcaccctcctctgattcctgtcagtcacccgccacatgccaatcccattggtgctggcgcccacacaccccacccctccgcaggcactcaccaatgtatgcgtaggaagcagggatggggtcagcgccggccccggagcctggaggccggagccacttcccgatcctggggtccgttcgggtcccggcccacctagcaggctcgggctgagtggaagctctaggtcccggggcttccggcccttctgcggctgggagatctcagggctggaagccgcatggccgcccgcctgccctgcggtgtccataacaaccgcgggcagccgggctggcacgccctcctgtggagggacttctggctcggccttggtggtttctggcacaaaccctctctcccccgcaacttccaactcttccttgggcccttctactttcacttctgggggcaaagcccggcccaaacccggctccacattaagctcttccgatttcaggtttggggcctcgggcggggtcaggatgacctggtagaggagcaggcacaaagagggtgtgtaaggattgttgggaccacaggattctcctgtgggccacccagtgatttccccgggaaggtggcacttggtactcagggcatgactgcacatcagagcaagtcctccaacaggacataggacttcgtcaaggaagtagggcttcctctggggcaggtcctcctatgggacaggggacttggggtgagacaacctgaagcgggtaggaatctgagggataccatcctcattcattaaaacagtggttctcaaaaatttaccttcctctggaccagcaatatctgcctcatttggtaacaagttaaaaatgcaaattattgggcccctccccagccccacaaattcagaaactctgggggtgtgcctggcaatctgtggtttaacaagacctacaggtgattctgatgagcactagagtgcgagaaccagtgcattaaacatattccaggcacctacatgttcggcagctactaactgtagcacagtattctcccctttctgtctcaggatttgtgtagctctctgccccacccctccttctaagaggatgtcttccttccaccattatctcctttaacgggacagctatgtctcttctaccagcctccctcgtcatccggggattacacatccctcctctttactgcctcctcttactgaatttctatattccagtccttacctgcagaggcaagccggcctcttcagcctccagacaggcctccaaggggcttggactggtgctcctgctccccgaggggggcgctgctgcccctgcaggagctgcactggggagcaccacagcaggccgaggatgagggggtggctgcggctgcagagactggatggtgaaggtggaatagaggcccgagcgcatgtactcgttccggctgctgcgtgccaaaccgcctgggcctgccattcctgcacccttgggtgtgcctggctttccagagacagtgtcccctggggcggcatgtatagcagcaggggccacatttggcatggtggaggtaacagacacctctggctggggcgggcagtcctcagtggagcaccctgcgacctcagggtaggacacaaacttgtagacgaacttctggccgctcaccttgcggatgatgttctaggaagggaggagaggaacagagggccttagaggaaaggggcaggctggaggcagggtgtcaggggggaggaggggggtggagtggcatttctcttctcctagtggctttcttcccacttgctcctctccggctttcccgtccctcctctgtaagtttctctctcagcccatttcctctcccattggtttctacctctttcctctcccgccagattccccttatctatatccctccccagttcctcccctttctctcttctctccacaataattttttctttaagccccttcccatccacccctttccaagcctccctttgtcactctccaggtccgtctatctgattttcccactccctccacactgtagctcctcttcacaatggggcccatgaagggcagtaggtgtgggagcaggtcttcttcctggctccaagaaccagaggttcacagggccaggccttgtgggtgactgtcaggacacagttttggagactagcaaatgcaataagacaagaaaatgaagtaactgatataaatgttggaagaaagtaaattaatgtagatggatggggtgatgaattattaatacagaggattatttgaagctaatgatacagaagtggaacagggcaaggtcactgcagaggagagggtgaggaggcctcattattaataccactgtggaggttgaagctaaaatggtaagaaaatgaagtaactaacagcaattagacaagaatattaaaaatactggtataaatattgggagggggcctatatcaaggctggctttgctgggtcacagagcatgtttggggtttttcaggtctggtgggtctcagagatgacctagtgttcccagagggcagagtgagatagcctcattactaatattgttctggagggttgagctcaaggaataaaatatgaaaatggaataaatgccataaactatgaagggtgtgcagcatatgaccagggcagttctgggagtgtggaggcactagggcattctgtggaagtcttagtgctggtcagatatgtcacagggtgggcctgtgtttctcggaagaggaataaaaagggatattcatgaatattgtttgggaaatttcagtagaaggattaagaaaatgaaataactggtataaatattggggggaggagaaacccagcagtggcctgggggtctgagagggcaggatgggggaaattttaaattttagctgtaggaataagataatgaaaacaattgatataaatattggggtagaccagtgctcctctgggaatttaagaagacagtgtgtggaagttggcattaaacatgttgtttcagaggttttagcttaaggaataagagaagaaaataattagttaaaaatgttgggagtcccagaggacgaagtaagcaaaagttggtataatactgtcagggaggttttgattctaggaatatgaaatattctggaataagagaagactatgaaataactagggaagcccagcactggtccaggggtttcagaggacagaatgaggaccagccattattaaccgtgttttcaagatgttggctataggaatacggcaggaaaatgaaacgttgtgcatggcagggcagcatcactttggggatctcagagtgggagtagaaagagtcagtattaataatgcagtggtggttttcgccaaagcagtaagacaagaaagtaggtgagatagtgtttaggggcccaatactggtcttagggtac

SEQ ID NO: 54 - DNA, 4406 bp, Homo Sapiens
ccagcctggactccccacgcttggggaaaaaggctgcatttggagcccgaggcacccatcacctgcccaccccaggcaagggtcgttcacactcaggggctgaggacatccccgatgcagccacctcagtccacgggagctggaggtcctggccttggcccctcagacatggcaccgcagggcctcgtgctttgcaagtttctaacaaatgttggctttatgggtattttaagacagaagagagaccggaatccatcccccccacacccatgcaggccaccctctccagctgcctcctgcccccagggcagcggccaccaccccacagcctggtctgtggtgctgttgtggacggctgtggcacctgtccccatgcccaccatcggctggggtctcatcccaggccacacagtcattgcacagcagggcgggttgtccaggtggcagagcccgggatccccaagcccttccacggccaagggccccacactcaccagcttcacgcagatgacgaagggtggccgggcggctcggaagtgcaggatggggattcggggcttgggtctttcctgagagtgacagtggccatcagtcctgcccgagcctggagcttgtccccggagagacgccctcagggtgcacgcagccaccaagttggctcacacaggagccagggcttgggcagcagataacgtgccagggtcacagactgcggcaggtgttcagagcaggaacccggctcccgccacccccgcctgacacccgactgcagaactgaccagggtgggctaccccaaggcctagacccacgagggacagcggggttctccccccaagaatgggggctgggctccctggaggccccgaggagccagcacggcccaggtggactctgccaagggggaaggctcggagcagctgtccctcagccccggagcaggtggttgaccccaagggtgacaccatgcggccctgcacacctgagagtcctcgtggcaatagaagcctttcctgatcttgttctcgtccacgtcacagaatgccaccacctggggacaagcacagaagggcagctctggacaggccggggccagggcctgtgctgtgggacagtacgggggcagggcaggcagtgttggagggtggcaggatgctcaccttgcgctggctgccggcagtcaagctgcggtacagccggcgcccctgcttgccagcgttccagatggtgaaggccgcccagcggggcagggcctgctcttccaggaagcggacgcggtgggtccagatggtcgtcctgcggtggagaagagggtgataggcaggccggaggccccacagatgcacacagatgctgacatacagggacatgatgtgtgctcagctcacgttgccagtggagtggacacctggcccaatgcctaagagagactggctgtcctacagtcaggccacctgccccagctggacgtagccacatgcctaggtggggatccaccccttccattagaccccaacaggtggggacagatgagaagctgtcacttaagaatctagaaggttctggaaggcagaatttctgtaggacgcagaggactggacttgacccaagtccagtttcccagagaaacctttgtccataaggacacatgcaaccatcccataaaatcccagcgttcacacttggacacgaccttctgcctcagggtcgctgccccgaacccttccactcccctgggaacctggtctctgttctccctctgctgtgacaagtcgaccccaggctgctgtcccggggggagcaggctccttcccatgacctgctgctctgcccagcgcccagccccatcgctgcccgggcccttcccagccccgccctctctcctcccaccgcagcccctccccacgtgccccatcgctgtctgcctgtgtgtgcctctccctcaaccctgctcctggagctgcccgggctgagcccgtctcaaagccccaggagctggacgggccagaagctagaggggcaggggatgcagaggccaacggggccagaacggcgtgggatgtgtcccagatgctgtcctccccaatggccgcgatgtagccacgctgaagcccggtaccccacagaccctgccctggccgagtcctgggatgccctctgctgtgtcaagggagctgtgtccgtgggagtctcctccggggtggggtctgggccagacacaaccaacactggctggtgacgggcctcccctgagcagggccctcgtgggttcagcctcgggatcggggcaggatttcgctgttctacgattctgctgctgcctccgcctcccgggataaacttgtgactcccccccaaccctgtggcaccccctgtttgtagcagaacccccacaggcaatgggatgggggggatggggggacacggggtcccctctgtcagctcagggagctgcagggcttaggcactgtcagggaggtcctgcctggagtctaccttttcctccccaaccctctgcagccacctcaatagtccggaccccacctgggacacagggagatgcttatcccagtcagtgacttggggacactgaagcatgtgtgtgtgtgtgtatactgtgtgggggtgtatggtgtgtgtgtgtgtacactgggggtgtatggtgtgtgtgtgtgtgtacactgggggtgtatggtgtgtgtgtgtatactgtgtgggggtgtatggtgtgtgtgtgtgtatactgtgtgggggtgtatgtgtgtgtgtgtacactgtgggggtgtatggtgtgtgtgtgtgtatactgtgtgggggtgtatggtgtgtgtgtatactgtgggggtgtatggtgtgtgtgtgtgtacactgggggtgtatggtgtgtatgtgtgggggtgtatggtgtgtgtgtacactgtgtgggggtgtatgttgtgtgtgcacagtgtgcatgtgtggtgagtgcatgtgtacatgagcacgtgtacagtgtgtgcaggtgttcggagtacatgcctgtatgtactgtgtggatgtgtgtacacgcatgtgtacacgtgtgtgcagtgagggcctgtgcatgcagtatgagtacatgtatgcagtgagtgcacatgcctgcatgtaccgtgcagatgtgtgtacatgcagtgtgtgtgcacgtgagtgcgtgtgtgcagtgagcgtgtgcagtgagtacgtgtgtatactttcgtgcacgtatgtgtgtgcatgctgtacatgtggtctgtgtgcacgtgcagtgtgtgtgtgtgtgtgagaacctgggtgaggacagctcctgcagacggctgcggggacttccccaccaggtgacgcagcctcgccgggttttggcatcttgtccttagcagcccgggtgtgttgggtgtctcggggcggggggacgagcctgatcctcctcatccactgacatcagcttagggaccccagggggttcacgtgacaggaaagcagtcagggctccagaagaaagcggggggcctctgtggccgtgggtggcacgcgaggtttggggggcctctgacaccggcctcctcgacggccccttgtctcctgggctttcctaggggtctctggtctgaaaatgttggcccatcgtaggaaggtaaaatgtagaagcagccatgatgtctgtatttggttcatcttcatttttcacattttaaaaagttctcatttaatcagggagaacaggctccccagggcgccctatgcctctctttttacatcctcagaggaagccgtggccccgccttagcaccgggaaaggtggaaacccagtttttcccaaaagcacaagacagcatttctggaaatgttgcaaaggagctgaagtgtcagggacacgtcaccgcatgaggaggcggccaaggtgccggtgggcataagggagaggagcgcggacgcgggaggccccagcatgcaggagtgaggatgatgcccccaatggggaagctcgtggccctcctgccaaccccccagccccaccccgtgaccttggaccttagaccccctggggagctgggatcttgccgagagtctcaaccccatcacggcaggcctgggaccatcgcggctcccacacccacacatgaccctagttggggtcttgagactccgggggccctgagtacccgtaggggccgagacgcaagcctcggacggcggcctgctttccaacttaacgctgcggcacgcggcaggcaggtggccgagacctctgtgtcctcacagttctaaggagggaactgtctgcccggatctaaggaaggaattctacatgcagtttcaccccgatttgcctcacccctgccacggctccaacgcagccacgcggcacccccagacccgggcccacgtggccgctcctcacagtgacacg

SEQ ID NO: 55 - DNA, 4417 bp, Homo Sapiens
gaaaccccgtctctactaaaaatacgaaaagttatccgggcttggtggcgggcgcttgcaggagaatgcagtgaacctgggagcgggaggttgcagtgagcagagatcgcgccactgcactccagcctgcacgacagagcgagactccatctcaaaaaaaaaaaaaaaagaaagaaagaaagaaaaagaaaagagggtggagatgggggatgacatccagctcaggaggtgtccatggtctggccttccgtggggagaaggaaggccacacgattggtgtggcccagggggcagggcctcagcattctaagccgagctccctcttccaccctctgaggttggcactggcagtccaggtgggggcttggggacctgaatgggatgaatgggccaagggggatgtcatctcttccattctccttcatccactgcctctcccttcccctcctcccccccctcccacccccggtccatctacctcccatcccagccaggagccgtcacctaagtagaaaaggggcctctggaaagggggcggggccttgactcttgggtaccctgcgcttgaagaggaactctgggaaggggttgttcagggatttggccccttccccacctggctgtataaccttcctgttcttttcttcccctagccggttgcccctccctgtcctgagatgtcaggaaagagggggccacctgcgtcctccacagtggcctccgaagcctggggttcccagccccagagctcagaggtgaaggaggtgctacagctctggtgaccactggttgtttcccagtcttctccatgccaccctttcccaaaacaacaaaacaaacaaacaaaattgggcctggcgcagtggttcatgcctgtaatcccagcactttgggaagccgagacgggcggatcacaaagtcaggagatcaagactatcctggctaacatggggaaactccgtctctactaaaaaatacaacaaattagccaggcgtcctggtgggcgcctgtagtcccagctacttgggaggccgaggcaggagaatggcaggaacccgggaggcggatcttgcagtgagccgagatcgcgccactgcagtccagtctcaacaacagagcgagactccgtctcaaaaaaaaaaaaaaaattgattggaacatcctccaagatgcaagactctcagttcctcagagttctacaggaaggatggcagagtgcagttgcccagagttgaagtcccatctctgccatttgttggctgtgtgaccaggcacaaatcattaatttctctgagcctgtattttaccatctgttgctattgagtaatagtagtggactattttctatttttatttttattttatttattttatttttttttgagacggagtctcgccctgtcacccaggctggagtgcagtggcgtgatctcggctcactgcacctatgcttcccgggttcaagcgattctcctgcctcagcttcctgagtagctggaactacaggcgcgcaccaccacacccagctaatttttttttttttttttagtagagacagggtttcaccatgttggccaggctggtctcgaagtcctgaactcaggtgatgcacctgcctcggcctcccaaagtgctgggattgcaggcatgagccactgcgcctggacgaacgtttttaattatattattattattattattattattattattactaatttttgagatggagctttgtttttgttgcccaggctgaagtgcaatggcgggatcttggctcactgcaacctccgcctcctaggatcaagagattctcctgcctaagcctcccaagtacctgggagtataggcatgcaccaccacgcccgacgatattttgtaattttagtagagatggggtttctccatgttggtcatgttggtctggaacccctcacctcagctgatccacccaccgcagcctccgacaattacaggcgtgagccaccacgcccagccgtccaccctgttttctaccagagttctgtactgtgactctgtataaaatagtttggaagctggacccaccctgtgtgtgtgattgccctgagcccacagaaagacacctccagagtgcggattgagaagcctttattgtgggaggatcggggtgtcctagggccccgggagacgggatggacttggaaggctggggggaggggcctttgaggaagaggagtcctggaagcgggggtcatcacaggtcaaggggtggtccttgggacccccgcagtcagtggtgctgcggcggcagagtgcacattgacagctgagagccacggcgtaggagaccacggggttcacgccgcgcgggcagccagggagccggatggactcgaagcgcacatcgcggtagttgcacaccacctgaggcagggccggcaggaccccctgcagcacgcgggtctggaagccgtgtgagtgggggaatgagcatgtgcctggggccagcgcctcagctgagctccccagctgcccccacaggtctcagactcaggggtccaggaagccctctgttcctgccctcccacaccccattccgcagcccctgaccagagaggcagaccacccttcctcccccgctgcctctgtgggtctggccctgaggtggcagcacctgccctggccccgggcagctcaccatggtggggcagtagccggcacagatggtggtgttgacggtgatgcacacggggcagccctccttctccacagccagggtggcattgatggggcggcaccgtggccgaagcggctccttggatgcccatgtcccgcccatgctcagcagcagcaacagcagcagcctctggggcaaggacactgcttcacccgggtctgagactgcagcccccagtcctggccttcccatcccgcatggtacaccacccacaaagacccagagacccttcccggcatcttctattcaggacccaccacccggacacctgcctttcagagcccaccccacagcccagaggacctgagataccccaacatttcagatccgcaccctcaggaactgacccacctgaagcttactgggggtcacgctcctccagaaagaggcctccttccacagctcacacgggtctgccccttctcatgccagtgatggcctggaaggaggtggaaggtgcccaggggccctgcagtctttcctggaacatctccatctttggtgcccggaaatgtggatctaccctacctttgacatgtctctctcttagcgggatatcttccgcaagcactgggaatgtggacatggaaagtaaattgagtctccgtgggggagtgagacagggagtgaggggtgttggacgcggcacgggaacctggccagagtcagcggacccaattggctgctctctctcagatgcagttccccttcctccctccagggggcgccacggaacgcagggccctcactggccctggggactgggtgacgtcagggatgagcctcttgtgattggctccatcaccctgcgtaagatcaaagggaagaaaggatgggcccgacaaccggagccattgtggctccggccgattgagcctgccctcgggctctcaaggctaggcgagggtgtgagggactggagttcgaggtcaacctgggccccattggtaggaaaaaaaaaaaaaatttttttatcgttccctatataacaacaaaacataaagggaggacgccttgataggaagaaatgacatcttcctaagtgtttttaaattacttcaatgtatctttttttttttttttgggataccgagccttgctcggtcctcgggggacctccctgcctgtcagccatggcggtcgtcacctgtggtaaacagaatggcgggagcaagtgggatgtcccactactcgggctgaggcaggagaatcacaggaacctaggaggtggaacctcctcgcccaggaggggcgcggcttcggacttagtttctgcccaatgagagagggcctccccgtgactgtgctgccaggttagccacttgaccctggtgccgccaacgagggattcagcccgagccccacctctcccttagggacctctgcccactctaccctcaagccaggatgcccggagcggtccccggaaatgcgtgtgcttcgggtgatttaactgattattgaataggcccgcaggaggtgtgtcctgcccccgaggccgcagcctcggaggacattatctggacttagtcccttccccgcgatgccatcaagctggacaattttaaggtctgtttctttcccaatgtagggtataggatggcacagggaagagggctagaaacctgacttgagctccccgcccagggctgaactctccagcatcctgatcacttctcattgaaccttgcttatac

SEQ ID NO: 56 - DNA, 4420 bp, Homo Sapiens
tccttggcagctctgggggccttcccttgcatttcgaaggaaggggaggcgtgtggctggaggtgagaggccctgaggccctgcctggctcccagcttcccaaatccgcctctctctgggtcgccgccctcagagattgctgaggacacgagctttccacccacgggctgtcctaacggagccgggctaggggcttctggacagaggccgcctgcccctttgggctttggggtttgtttttctcagcagctcacccgggtctctggggtcagggtatcgggcagaagtcagaggacggtgcgcttgggacctgagctctgggcagccctcggggctcaggactcctggctcttctgcccagtttcatgtgttttgtgttttgaaaccacgtgtggtcccacagttgtgccctcagaagccgccgtggctgccgtgaggtagcagtggacgggacgcccacggtctttcccatgccatgctgtttccagccgggccccatcactctcccacaagctgaaaggaagtggcttctccaccagccctggctgggagtcctgtgggcgaggccttccccaggagctgccctcccaagtgccccaggcactaacaagaccccacgcgtgctctccccacagccggcttcgtccaggcgccgctgtcccagcagaggtgggtggggggcagtgtggagctgcactgcgaggccgtgggcagcccggtgcccgagatccagtggtggtttgaagggcagggtcccaacgacacctgctcccagctctgggacggcgcccggctggaccgcgtccacatccacgccacctaccaccagcacgcggccagcaccatctccatcgacacgctcgtggaggaggacacgggcacttacgagtgccgggccagcaacgacccggatcgcaaccacctgacccgggcgcccagggtcaagtgggtccgcgcccaggcagtcgtgctagtcctggaacgtgagtggcgggcacctccctccccgcctccctcagtttccctcctgtgccgctcgcctcccggctcctgctcagtagaacccagacgcctcctcccctctccgtcccgctgtgccccgttgggcccaccgcctggacggaggggcccggacctgaagggggtgggctcgccgcctgaccaccagcgctgggcggcctggctcggggcaggcagggctctgccctccagcaggtgggtcctcgtcctcccctcgaccctcgtgccatccgttccgtcgtttctgcttccccgggcgcctgcccggctccctccctgagcgtccatactgcaagcctgaggggccctccaagctcagcccaggcttgcaggtctcagaaccttctgtgtccttcgcagcatctcgttctaagggattttcaaatttcaattcctagcgggaatattgtaaactaaccaagaaccaagagatttgcttggttggggattggcagaagaaccggggtgctcccagcactgctggagtgccgtcagcctggggctggggggatgtggggccacctgagtgcctcctagagaagggcacgggagccttggccgggggtgctgtggctattttttttttttttcctggagatggagtcttgctgttcccaggtggagtgtggtggcacaatctcggctcactgcaacttccgcctcccgggttcaagcgattcttctgcctcagcctcctgagtagctgggattacaggcatgagccaacatgcccagctaattttttgtatttttagaagagacggggtttcaccgtgttagccaggatggtctcgatctcccgacctcgagatccacccgccttggcctcccaaagtgctgggattacaggcgtgagcctccgcgcccggccaccaccgcgcccagctggctacgtttttagaaaagaatttccagtttgtgctggggctgctacaagagctcgatgccctggtccctgctcagggacgtgggtgggtgccttgtctgtccccacaccctggtcccagcctcgtgtgtctctgggcaggaacatcgccaggcggggcctctgggttcccagcgccttagcccagggcccgccagctgccagcgaagggtgccttcccgaagggggtgccttcccgaaggggcctcctcagcaggcgctgggctcttcccttcccggaggcgtggccagaagttccccttgggcctccggtcctcggggcgtaagggccacggtgtatttttgggatgaaaaccagtccttcccggggaggagccgcaggttcctgggggtcaggcaggcagcgcgggccgtgctcctccactctgctgaccgcgtctcgccgggccttgcagccggcacagtcttcactaccgtagaagaccttggctccaagatactcctcacctgctccttgaatgacagcgccacagaggtcacagggcaccgctggctgaaggggggcgtggtgctgaaggaggacgcgctgcccggccagaaaacggagttcaagtgagtgcctgaccacgccatgccgccacctgccccttctcacggctctcttgccgccagcggcctgtggtccgtgagaacaaaagaccggtcggcaggcttgatccaggcggaagttagggaccagctccgcgcagacccccagagggaaaccccagggaggggtctgaggggcgtccttgtgaggcagggggctccagcagccctggcaggagtccccattgcttgctcctcactaggtcccgggcacgaaagggcgccacactgccaggtcccgggcacgtgtgcgggcctcccaggctctgtgctcctggcacaagagggcaccacactgaggcatgccctgctcggaccccagacgctgtcatggccggagctttgtcataactggggctgggacggccctgggagcacagagccttttgttttcaggctgactgggaagacggtcacagggtgtggggtgcagagcagggaccagaggtgtggggttcatcagtcggggagaagggggtctgttggttctctcacctgtggggtcttgccagcctggctctgtccttggggccgcacggggaccccaggagttcttttgaggttcagacttgactgggacagttttgctttttcactgtgccgtggttgggcccctggagaaccctgggtccttggaggcgtcctgcagagctggtacgcggctcacctgcctgctgtggttgcagggtggactccgacgaccagtggggagagtactcctgcgtcttcctccccgagcccatgggcacggccaacatccagctccacggtgagtcctgcagccaggggtaccgggcaccaccgactgtcgggagaagttgttggcctgaggcacccggcacatcccagagccctggccccctgctccctggaggggaacagccctcctgcgggaggccggggatgggggcgggcctgcggttccaggctcctctctctcaccctcctgtcagggcctcccagagtgaaggctgtgaagtcgtcagaacacatcaacgagggggagacggccatgctggtctgcaagtcagagtccgtgccacctgtcactgactgggcctggtacaagatcactgactctgaggacaaggtgagaagccaaggaggctgggggtcctggacccagccctcaggactgggtgagaggcctagactgggggtcccggacccagccctcaggactgggtgaggggcctagactgggggtcccggacccagccctcaggactgggtgaggggcctagactgggggtcccggacccagccctccggactgggtgaggggcctagactgggggtcccggacccagccctccggactgggtgaggggcctagactgggggtcccggacccagccctctggactgcagccctccagactgggtgaggggcctagactgggggtcccggacccagccctcaggactgggtgaggggcctagactgggggtcccggacccagccctccggactgggtgaggggcctagactgggggtcccggactcagccctccggactgggtgaggggcctagactgggggtcccggactcagccctcaggactgggtgaggggcctagactgggggtcctggactcagcccttgcctttggtcccctaggccctcatgaacggctccgagagcaggttcttcgtgagttcctcgcagggccggtcagagctacacattgagaacctgaacatggaggccgaccccggccagtaccggtgcaacggcaccagctccaagggctccgaccaggccatcatcacgctccgcgtgcgcagccacctggccgccctctggcccttcctgggcatcgtggctgaggtgctggtgctggtcaccatcatcttcatctacg

SEQ ID NO: 57 - DNA, 4258 bp, Homo Sapiens
ctctcaaagtgctgggattacaggcctgagccactgcgcctggcctaaagtaattgtcttcttattggtttctctgcctttggtctcaccaaacgccccactctaaatcactgcagacaaggggttctgtctaaggaggagagcccaccagttaaaacccttcagtagttcctaactaccctaggacaaatgcagacttatccttcgctctctgctgccgcccctctccttcccagatcccatatggctccagccatatcctcagaccatctgggctgttgtctgtcctgccacacacccttcccaccccgctcccttgcaagtcctactcaggctgcacctacacagctgtctcagtttctatctgaggctcccgcagcctcctctgaaagtcctcatcacagccaatgatactgaaactgttttcttatgcagggcacggaaagatctattcaactcactgcccaatctcctctcctggtgcagaaaagacacccagtcagcgacttgcattatctgcaggcatgagtgaataataataatgcctaacccttatatagtgctaattccacgcctggcactgttctaggcactcatataaattcatgtaatccacacaaccccaaaactgatgatatctcttcatcttaccaagcactgagcagttaaataacttgctccagatattaaggggtcgagctggggtttgaagcctggttacccataaatgaaccaagaactggaaggaggacaagagctccgagaaggagtcaggtagggcgtgatctgtgcgctttacatctaagatcttccagctcccagggagcccgtttcatagagcaggagatagaggctgggagggacacggagagcctcgagagccgtgtggaggaagcggtgctgtttggggtccgggagcaagggcgtggcctggatgcgcgggcgcccgggacggcacgtcctcagaccaaactacaactcccaggacccagcgggcgctgccgcccacgcgacgtcacggcggcggagggcgcaggcggctgggcgcctggcgagtggactgttcgagcccttccgctgggacccgggccctggctccggccccgcggtaagtggggcgaccccagcctactcagtccgcggaggccccgcggcgcacgtccgcagcctccatcacagcgcgggcgcgcagacggggctggcatctaccatatggggggcatccgggccgaaccaagtgacccgcgtggggggtcccgctggggactccgtgccgcaccctcccaagccggccccaggggcccagggctggtgtcgcacgttcgctggccgcgctcccagggcccgggtttgaaggcgctgggcaggcaggggcagccccgccccctgagaagggtacccgggaccccggggcgctggggcgaggttttcgggctggaagggtctgaggggctcctcccccgacagccctcccaccgccagtagagcctcgggttggggaatagaagcccccgggaggctaggtcctttgggcgcggcctgtgtgcatctggggagacggtgggagtggtggggagaggtcgcccgggtctggggagaccgatgcacaggtggagagatggtgcgggttctgtggattcggatccttacaacttcctcttccccgccccggtagatgggagctgctctccgcgggctgagcctgtcagcatcctcgacgcaccctggtccctgaagtcggagaagagcccctacccacccacacccccttgccccattttgggtcgcctgggtcctcagtcctagcggatcctcagtcctagcggccaccgggtctgaaaggagcaagacgatgatcctggcgtcggtgctgaggagcggtcccgggggcgggcttccgctccggcccctcctgggacccgcactcgcgctccgggcccgctcgacgtcggccaccgacacacaccacgtggagatggctcgggagcgctccaagaccgtcacctccttttacaaccagtcggccatcgacgcggcagcggagaaggtgcgcaagggggcagccagcccagggtccgggatgtaggcgggagggagagtgttgggggttctctgctcaaggcctctctccctctctagccctcagtccgcctaacgcccaccatgatgctctacgctggccgctctcaggacggcagccaccttctggtaagattcacgccctctattttcctcgtggatcctggagctctcccagacactcaggctccagccccgccttcccttctcattttctcccagaaaagtgctcggtacctgcagcaagaacttccagtgaggattgctcaccgcatcaagggcttccgctgccttcctttcatcattggctgcaaccccaccatactgcacgtggtaaggtagagaggaccttaggtcagcgggccaccctgccccgggggcaagtggggagtctggggcccagagtggcagacgattgcttgcctaaaggtgtcagggccacacaggattcaaccccaggccttcagaagccaaaggtgtgtattcacggagcctggaagggtcgaagtgggggtttgatcacgtggtcgaccagctgggtggtgatccccatgggtaggtgggggtggctgttctctgctcagtgcccatgcggctttgtgaattcccacacctcttccttgcagcatgagctatatatccgtgccttccagaagctgacagacttccctccggtgagtgctgggccagagcagggtgaggggctgagaggttgggcttggaccacccttcctcatgactctgtgacctgcagatcaaggaccaggcggacgaggcccagtactgccagctggtgcgacagctgctggatgaccacaaggatgtggtgaccctcttggcagagggcctacgtgagagccggaagcacatagaggttggggcagcaaaggagaggccgggcctgctgggggtgggaagggcacgggattctgagacctcactctttacaggatgaaaagctcgtccgctacttcttggacaagacgctgacttcgaggcttggaatccgcatgttggccacgcatcacctggcgctgcatgaggacaaggtggggctctgggacctgagacccacctgggaacattaagtgagacagaggagactgggctggggatccgggtcaagggcctgggggctgaggctgtggggctggtgctttggggcagttccgaagttgccagcatcttggggtggggctaggggcgtgggtagtcctgacctcctttctccggccagcctgactttgtcggcatcatctgtactcgtctctcaccaaagaagattattgagaagtgggtggactttgccaggtgaggcaagaatggctcagggggtgggcagacatctggggcagggaaggcttgggtctgagcccttgcccggggcatgatctgcggggagcagggtttctcaaccatggcactattgacatttccagccagataattctttgtcacaggggctgccccgtgcacgttaggaagttcagcagcatccctggcgccagcagtactgcctagttgtgacaaacaaaaatgtctctgcacattgccatatgttacttaggggggcagaattgtttccagttgcaaaccactggtggaggggcccctgactgaaccctcgctcctatccgcagacgcctgtgtgagcacaagtatggcaatgcgccccgtgtccgcatcaatggccatgtggctgcccggttccccttcatccctatgccactggactacatcctgccggagctgctcaagaatgccatgaggtggggtggcttgatgtgctggcttgggggcggacaggaaccggggtgcttgtacctactggtctttcccctctgcatagagccacaatggagagtcacctagacactccctacaatgtcccagatgtggtcatcaccatcgccaacaatgatgtcgatctgatcatcaggtttgccctgagtgggagttgagctgaggtggatgggatgggggtctaggcactgtttctgacttgatttaggaccttgagccccttcctgccccattctgggacttggtccctgaccagacaaactattctctgaatcctgagatggccatgagctgcttattaatggatctggggccagctgcaggcctaggtatcctgcctctgtcagcagctgaggagcttgaaattgagaaatag

SEQ ID NO: 58 - DNA, 4435 bp, Homo Sapiens
cgcaggcgcccagggctcacaggctcggagcggcctccgcctctgccggaccacccagggccgccccgccggaggggcctccccgcccccgagccctaggtcacgcccggaaggcccggggcccccgcgtccggccacgccatccgcccggcggccccagggactcagcgccggggtcagcgcaggccccgcccagcgctcccgccccctccagctggccggcccccgggaccgcgcccccgcccgcgctctccacgctcgcactcgtatgggcagggcggcccggggtcccccagctccgagccgcggccccttgaagcgcgttacctggacgtgcgctgtccgcagactctggacgagctgggcctgggcgctgcgcggcggaaccgaccctgtcctggaccgcaggcagcagctgaccccgcgccaccggcctgcgggcgagacctcaggcgcgagacgggctgtgtgtgtgtgtgtgtgtgtgagagagagagagagagagagagagagagagagagagagagagagtgtgtgtgtgtgtgtgtgtgtgtgtgtgtgtgtgtgtgtgtgtcgggggaggggcccgaggacccgcttcctagctgagcgtcaggacggggggcggactctcaggagccgcgcggcgcccgcagaggagaggaagcgccggagacccccctgctcccacccggcctccctgccccgcttcctttcccggggctccagagaggggagctccaggcgtggggcgcctggcccacgtggtgcggcgccgggcggggcaggcgggggcgcggcgagagccgcggagctttctttatgggtgggggggcgggggcggccgggctccgcctccgggggatcggggcgcgctccgccaatgggtagccgggcgcggggcggggccgcggggccgccgcttaaagaaacttgttgcgggtcccgcagcgggacccgagcctcggcggcggcggcggcggcggcaggggcgagggtcggggccaccgcgcggcgacctcgggtcccggagcgaccgcagggcagccccgggcgccggccccggtgcgcgtctcctgtgcgcgcccctccgcgcgcggccccgatgctggacatgagcgaggcccgctcccagccgccctgcagcccgtccggcaccgccagctccatgtcgcacgtggaggactcggactcggacgcgccgccgtctcccgccggctccgagggcctgggccgcgcgggggtcgcggtggggggcgcccggggcgacccggcggaggcggcggacgagcgcttcccggcctgcatccgcgacgccgtgtcgcaggtgctcaagggctacgactggagtctggtgcccatgccggtgcgcggcggcggcggcggcgcgctcaaagccaagccgcatgtgaagcggcccatgaacgcattcatggtgtgggcgcaggcggcgcgccgcaagctggccgaccagtacccgcacctgcacaacgccgagctcagcaagacgctgggcaagctgtggcggtgagtgccggcgccccgggggcggggttcgggaccttggccgcccctggtctcggactgcgagcgggggcctggagggcgcagagctcgcggaggtggtggccacacgcaggctccgggctctgcaccccgggcgggtgtcagggcgggtcccagtggaaaaacatcctctggccagccggggtccggcgccagctatgggagtcgggatccgcggagggcagcgcctggggtgtgcaccctcgtggcgggtgcgctctggagccagttctcctggcggggaacaccctgcggagggccatggctggcaccccgacgtgccctccagccgttgcgagtggccccagccccgggaggcacgcccggcacgacagcaagttgcatgcggctctctggaggtgctccctccttagaaagggctcagctcctctagctcctggaccacccatggggagggagtgcggcaggcggatgggtgggcagcaggtttgcctgcgagtaccctccccgcagtttctccctctcctggacaccctcggtccgaagcagggagggcaggagtggagatgacggggtgcgccgtgtgcacgccttggcgtggtggggccggtcagttttccagaaattaggactgcagagtgaagaacttgttgctcaggacaggccgcccccaccgagtgtcctctggttgggtttcaaatggttctcttggtttggggctctggttcccgtatcctgctcctcacctggaagaagggagcttggagcttgcgtatttgcacctcctgccttctgtctggatctagggcgcagccacggggcgctgtggacggcaggcccctgctcccccaagtcctgccgcacaggcggttggaggtgagcctcgggaagagtcccaaggagtgtgtcctgtggctcagtgaggacgggcgcctgggccctgccagggcttctgggtgtctgggaatggagggacagcagcccagctgcccgccgaaggccggcaccgttcccgggaagcctcgcttttgtccaccgccggctgggtcctgcccgcctcccccgcctcccttagaaagccccagagggagggaacagcaggcccggaatagggggaaatagaaggaggaagatgggaggcgtggggcttgttcttctttggctgtcgtaagcataccaaccttcccaaacaggcgccggccggttctcccagaggagtgtactgcctggtgccacgggaggctccggagcgcacggcaggcgggtttccctggtcagagcctcctggccccggcctctgctgccggttccccctgtggtgtgtgcctgcgccgagggcacagtgggcgccctggccatccctgcctctgccctgtgctgcagcttgctgagcgagagcgagaagcggcccttcgtggaggaggcagagcgccttcgcgtgcagcacaagaaggaccaccccgactacaagtaccagccacggcgcaggaagagcgccaaagccggccacagcgactccgactcgggcgcggagctgggaccccaccctggcggcggtgccgtgtacaaggctgaagcagggcttggagatgggcaccaccatggcgaccacacaggtgggctccaggccccccgcatatctgagggtccctgtatgggaggcagctgtggggtttctggctgagaagggtgcatgatggtggaggggggcaggcgccctcgagagaaccgggccttccccgggttccctgaaaaagctcccaaggccccggccgcccctgtttttggtgcacgagggacctgcttagccaccttgagtgctgaggggctgacagctttgcttggcagggaccccgagaggtggtgttttcagcaagactcagtccaatgcgggctcctcttcccacaccgagctgctgcccacacggcactcagcagccccagcttcagggccagactgacagggtggagtcctgccggggcctcggtcaggctggctgacgcccgccagcctcagagtgcttggctggcccggggaggaacagggtctgtgtggtcccccagcgccctgtaaaccccagctctggccaggctgggcctgtcggcttcttccccccaccttggtctctgggaggggcctcgggtcttctcatagcacagcgcttcatggaattttctcggccgaggagtgaggtctaggtctgactttgctggaatttctgggaaatgtaaagaaacaaaaagccgttgatccccctggcagttagcgcgggcgtccctccccttccagcctggccggccccacccgccccacagaaggggcattcatccctgaagcctgctctcctgtccccagggcagacccacgggccgcccaccccgcccaccacccccaagacggagctgcagcaggcgggcgccaagccggagctgaagctggagggacgccggccggtggacagcgggcgccagaacatcgacttcagcaatgtggacatctcggagctcagcagcgaggtcatgggcaccatggacgccttcgacgtccacgagttcgaccagtacctgcccctgggcggccccgccccacccgagccgggccaggcctatgggggcgcctacttccacgccggggcgtcccccgtgtgggcccacaagagtgccccgtcggcctccgcgtcgcccaccgagacgggtcccccacggccgcacatcaagacggagcagccgagccccggccactacggcgaccagccccgaggctcgcccgactacggttcctgcagcggccagtccagcgccaccccggccgcccccgccggccccttcgccggctcacagggcgactatggcgacctgcaggcctccagctactatggtgcctaccctggctacgcacccggcctct

SEQ ID NO: 59 - DNA, 4784 bp, Homo Sapiens
cttggctgcactgggactcacagagccacaccctggagggcctcccccttgacactgataagggtgtgcattacatttcagtgagcgctacacggctgggggccaacgggagccacatcccccagacctccagtgtgttctccatcgaggtctaccctgaagaccacagtgagctgcagtcggtgaggacagcctccccagaccctggtgaggtggtatcatctgcctgtgctgcggatgaacctgtgactgttttgacggtgattttggatgccgacctcaccaagatgaccccaaagcaaaggattgacctcctgcacaggatgcggagcttctcagaagtagagcttcacaacatgaaattagtgccggtggtgaataacagactatttgacatgtcggccttcatggctggcccgggaaatgcaaaaaaggtggtggagaatggggcccttctctcctggaagctgggctgctccctgaaccagaacagtgtgcctgacattcatggtgtagaggcccctgccagggagggcgcaatgtctgctcagcttggctaccctgtggtgggttggcacatcgccaataagaagccccctcttcccaaacgcgtccggaggcagatccatgctacacccacacctgtcactgccattgggcccccaaccacggctatccaggagcccccatccaggatcgtgccaacccccacatctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaacgccttcaactgactccaccaccaccacgactcgcaggccaaccaagaaaccacggacaccccggccagtgccccgggtcaccaccaaagtttccatcaccagattggaaactgcctcaccgcctactcgtattcgcaccaccaccagtggagtgccccgtggcggagaacccaaccagcgcccagagctcaagaaccatattgacagggtagatgcctgggttggcacctactttgaggtgaagatcccgtcagacactttctatgaccatgaggacaccaccactgacaagctgaagctgaccctgaaactgcgggagcagcagctggtgggcgagaagtcctgggtacagttcaacagcaacagccagctcatgtatggccttcccgacagcagccacgtgggcaaacacgagtatttcatgcatgccacagacaaggggggcctgtcggctgtggatgccttcgagatccacgtccacaggcgcccccaaggggatagggctcctgcaaggttcaaggccaagtttgtgggtgacccggcactggtgttgaatgacatccacaagaagattgccttggtaaagaaactggccttcgcctttggagaccgaaactgtagcaccatcaccctgcagaatatcacccggggctccatcgtggtggaatggaccaacaacacactgcccttggagccctgccccaaggagcagatcgctgggctgagccgccggatcgctgaggatgatggaaaacctcggcctgccttctccaacgccctagagcctgactttaaggccacaagcatcactgtgacgggctctggcagttgtcggcacctacagtttatccctgtggtaccacccaggagagtgccctcagaggcgccgcccacagaagtgcctgacagggaccctgagaagagcagtgaggatgatgtctacctgcacacagtcattccggccgtggtggtcgcagccatcctgctcattgctggcatcattgccatgatctgctaccgcaagaagcggaagggcaagcttacccttgaggaccaggccaccttcatcaagaagggggtgcctatcatctttgcagacgaactggacgactccaagcccccaccctcctccagcatgccactcattctgcaggaggagaaggctcccctaccccctcctgagtaccccaaccagagtgtgcccgagaccactcctctgaaccaggacaccatgggagagtacacgcccctgcgggatgaggatcccaatgcgcctccctaccagcccccaccgcccttcacagcacccatggagggcaagggctcccgtcccaagaacatgaccccataccggtcacctcctccctatgtcccaccttaacccgcaagcgcctgggtggaggcagggtagggcaggggcctggagacgacatggtgttgtctgtggagaccggtggcctgcagaccattgcccaccgggagccgacacctgacctagcacacactgacacaggggcctggacaagcccgccctctctggtcctcccaaaccccaaagcagctggagagactttggggacttttttatttttattttttgcctaacagcttttggtttgttcatagagaattcttcgcttcatttttgatggctggctctgaaagcaccatgtggagtggaggtggagggagcgaggaaccatgaatgaactcgcaggcagtgccgggcggccccctggctctctgcgttttgcctttaacactaactgtactgttttttctattcacgtgtgtctagctgcaggatgtaacatggaaaacagtaactaaagattaaattcaaaggactttcagaagttaaggttaagtttttacgtttaatctgctgtttacctaaacttgtatgtataatttttgggtgggtatggggaattgctttgctaaaaataagctcccagggtgtttcaaacttagagaagaccaagggacagtattttttatcaaaggaatactattttttcacactacgtcaacttggttgctctgataccccagagcctgattgggggcctcccggccctggctcacgccaagtccctggtgctgggtttgctctcccgctgttgccaggggctggaagctggaggggtctcttgggccatggacatccccacttccagcccatgtacactagtggcccacgaccaaggggtcttcatttccatgaaaaagggactccaagaggcagtggtggctgtggcccccaactttggtgctccagggtgggccagctgcttgtgggggcacctgggaggtcaaaggtctccaccacatcaacctattttgttttaccctttttctgtgcattgtttttttttttcctcctaaaaggaatatcacggttttttgaaacactcagtgggggacattttggtgaagatgcaatatttttatgtcatgtgatgctctttcctcacttgaccttggccgctttgtcctaacagtccacagtcctgccccgacccaccccatcccttttctctggcactccagtcccaggccttgggcctgaactactggaaaaggtctggcggctggggaggagtgccagcaatagttcataataaaaatctgttagctctcaaagctaattttttactaaagtttttatacagcctcaaattgttttattaaaaaaaagatttaaaatggtgatgcttacagcagtttgtacgagctcttaagtgttgattccatggaactgacggctttgcttgttttgattcttttccccctacttttcctaatggtttaaattctggaattacactggggttcttttgccttttttagcagaacatccgtccgtccatctgcatctctgtcccatgactcaggggcgcccactctgcttcgattctcctcctgtggaagaaaccattttgagcatgacttttcttgatgtctgaagcgttattttgggtactttttagggaggaatgcctttcgcaataatgtatccattccctgattgagggtgggtgggtggacccaggctccctttgcacacagagcagctacttctaagccatatcgactgttttgcagaggatttgtgtgtgctgcctcaggaggggagggctggtaggagggggggagaggtctctgtcctactgctctccagagggcatttccccttgcgccttctcccacagggcccagcccctctcccctgccccagtccccagggggtactctggagtgagcagtgcccctgtgggggagcctgtaaatgcgggctcagtggaccactggtgactgggctcatgcctccaagtcagagtttccctggtgccccagagacaggagcacaagtgggatctgacctggtgagattatttctgatgacctcatcaaaaaataaacaattcccaatgttccaggtgagggctttgaaaggccttccaaacagctccgtcgcccctagcaactccaccattgggcactgccatgcagagacgtggctggcccagaatggcctgttgccatagcaactggaggcgatggggcagtgaacagaataacaacagcaacaatgcctttgcaggcagcctgctcccctgagcgctgggctggtgatggtcgttggactctgtgagatggagagccaatctcacattcaagtgttcaccaaccactgatgtgtttttatttccttctatatgattttaagatgtgttttctgcattctgtaaagaaacatatcaaactaaataaaagcagtgtctttatt

SEQ ID NO: 60 - DNA, 4337 bp, Homo Sapiens
cagcatgaggaaacttagctgtaagaaaggagacctgggaccatgtgggtgctgtgcccaccctcttgacagcatccctgttgtgggagcagatgtggcagaccctgaaagtcgggaggagaggaaaagaggtgctctgaggaggctgattttggctgggggtgaagaggagctttcctgcaattgcagcaaatttatggagcgatggtctctactgccatggaaataactagcagaggctttcactcttttggactcttaactacaggaggaactactacatttttctgtaatcctgtgcacacttaggaaaagttgaagtagctttcccaaaattacttatcctttgagattattgcttagatagtttctatgttttgtttgtttcttaatgctgttgggatccactaaattgatttcagaatctgctaatggtccaggctgcagttggaaacccctggtctcagcagagctgaactccacccgtggagatgttaggagccaggaggattaggggtgggtgcctctgggcttccactccagtcttaggggttcccttcccctgccgggtcacgtgcaggttgtgaaggttttacctcctcagcagtacattaaatcctattatcccacttaagctaatcttgcccttcccccacccgagggcttcgcgtggacagaatattaagcggacaagcccgcagggtgcctagactaagtgctgagcttgtagtgaatgcccagccatgacttgcagtggattgacctgtgcaaaaattggactctcaagctgctagccccagtgtcagcacgagctcggccgagttcatttggtcgcaggaacaagggggtcgccaggagcaagagcggagggggcgcctaaagggaggagaccaaggcctaatcaccatccgccccctaactccctaggcgcatagcggggacgcagcgtgtccccaaaccaacgccactagcagagggtcccagaggagccggaaggggccagggcctgggcggcggtgggagggtctgagcagtgggggcggggagctgggggtcggctttcgtccgcgtcccagcgctccggcggccgccggggctactgatcccgggcttggcccctgcggcagcgccccgagctgccgcccctcgcgctgccagcgcccgggaaggaggaagggggaagggggcgggccggccgggctcacggccgacttcctccttcagccccgccctccgccgcttgcgggtgagctctgcccaagccgaggctgcggggccggcgccggcgggaggactgcggtgccccgcggaggggctgagtttgccagggcccacttgaccctgtttcccacctcccgccccccaggtccggaggcgggggcccccggggcgactcgggggcggaccgcggggcggagctgccgcccgtgagtccggccgagccacctgagcccgagccgcgggacaccgtcgctcctgctctccgaatgctgcgcaccgcgatgggcctgaggagctggctcgccgccccatggggcgcgctgccgcctcggccaccgctgctgctgctcctgctgctgctgctcctgctgcagccgccgcctccgacctgggcgctcagcccccggatcagcctgcctctgggtgagtgccggggacccggggacgcgggccgggggaaggaaggctgccggggacgtgcctcgtgcggaggtggccgtgacaaaggaccaaggaggggacctgtcggaggcacgggatccattaggaccccttcttttttcaaggcgctgcgcggagggagggagaggagaggggagctgtggggccgctggcccctttcttcagttttctttctgcgtagggatggggtctagcccgctctgtcgtcccccctagttcccttaggaggatgcactttcggcggggtccgcctgcccatctacttgtctttgatgctgaccagagccgaccgcggtgccgcccccgagggcggctcggggtagagggaggccactgcttgcagtcctataaacactggggttctggtattcccagcaagtcgcagcagggccgggagctgtggtgggcgggcaggcgcccgatcctccctctccgcccctccatccctggcttgccagtgcagccccaagccccagcatggagagacctccaggccctgggagcgaccagactgcggatgggggcagctctgggcgctgacattcccaagtcctgggagcgaacagactgcggatgggggcagctctgggcgctgacattcccaagtcctgggcgcgacccctcctcagagtgacctgggagtagcatcctggttggctgggttcctttcctggtcctcacatctgcttctgtggccacctcctgtttcagccctccgcccttccctctccttttcccttccatccggttgcttctccagctcttcttggggcacttgggctttagattcagagggtcctggatcccaagcccatttcttccactgggcaagtaagtgccttctgctcccagtgccccacctttctcatctgcaaaataggcagtcgtaggtgccttgcaaggtgtgttactcgggtatgaagtttataagtgcccaacagatgtatccgcaagccctttaacttgttggttgtcatattgtatgacttggaataaagcatgtatgaattagaggttacagactgaaactgtcccagacttccatctcctcacagcatccccacctctaaaagcatcctgtttacaaagggaaatagtagaatcagcacttaaattaaggcagggccctagcggcttcaagtaaccctacctgaacccctgtctgaaatactgcagatgacctgggttcaaatgctacctcagccacttagtaaccatgtgaccttgagcaggctacttaaagtttctgggtcttgatttcttcatctgtaaaacaggtataataacagaacctacctcaaggtagtgaggattaaatcagctcgtgtttgaaaagtcgttaggacagggcctggtacgggaaccgctgaatgagtgttactcagctcagagtttacttctgtacatcttgcccagatctggggtgattctgcctggggttaggacagggttggggtgttagtttgactgtagccccttgggtgcttcagcttgtgaagtcaggatgaacaggtgtaaccagccccaggcctgctgtcttgctacttctgttgtggccacaactccctttgccctcagaccctctcatttttgggagaaggcagggtgagatgggggcagatgctccaatggactccacttatggccttgggaaagctgggccagctcatgggaccatgtcaaaagacggtaggtttcatgtccaactctggaactggatgggacaatcacagggtagctagaaggcaaaactggagagcagcgaggggaatcgaggggacctgcttcccgaggagcagctagaatacttggttattattaccaatgcagctgcaggacctggtccacttctacaagcccgtgactgttcccaggcttctgtcacgcaccagcattcacctgtcagggctgccgtaggtgggcttgcattttgtgcattgtaccaaggtgcccagctgagggttgagaggacctgaaatgcagtccacactcagctctccaacctaagagtcctggagcaaaagaccccttctgctatgttcttggggctaggtctgcccggagtggcccatttttccagtcccaccaaagccctggaatagtgtagtggcacctagctacctgaacttgtgagcacgtatctatagtcgactgagttgccactataccctggagtgccccctctctgggcttcctcctggccctcatacccacctcctactcttacctacgtgcaggtcctagggctggctgggagtccgagaggggaatgccctggtaactgaacaggctcacccttgagtgtggcctaaggcggtttcctgcctcatcccagggggctcattagatgttcctggcagtgtgcccatcctgggcaggctcgtggtgaccatgggacgccgggcccagggccctagtgccctcccttgcatgcatcttaggagaaagagtcatggaactggatattacacacccctctttcctcctgccactcactcctctactgaattcccacccatgccccgtaaggacccagatgcctagggacagtggggctatgtctgtggtttaaaacaaaatcccttgaagtggagcgtccagcttgccctgcatctggggtccttcatagggaaccctaattattgttgatgaac

SEQ ID NO: 61 - DNA, 4388 bp, Homo Sapiens
agccatgagtggattagatgccaaaatccctggctgagagaataaccttaccctggaggaaaacatattagctttgactctgagctgggaatttcggtgatgttgtagattcaatgcattgcagttgggtgtttttatttgttgaaaggaattgctgaattttcaaatccattaactgcttgtcagcattagcaagcctaattagttaatactaagtaaatttgcactaaatatacaaccctggctgattttactggccacgtctggcagagggcagcagcagggagaaagctctgtagagtttctgttggaatcgtgtgaaaagctggagaggttgcttctctttctctctctctctctttctctctctctctctgacacacacacacacatacacacacacacaattgtaataataataatattttggttcctcactaagccaatctaaatcgcagaagtctattttgttaagtaagcttggccccagccatatgttgctactcagagaatttaatatcagatttcatctgactgtaaacgtgaatcatcaggttgcacaaggaacacagtggcagatccagggggcatttaacttttatagcattttaaatgaaaaaaaaaaaaagtaacacttaaacaagtaatttagatcatgctgtaggccctgaatagctttgatgttgtgttttcatggcaagtctccaacttgagctgaattttcccctactaaaaatgcaaatttttctaagaccttctcttggtcctgctactcatgatacatatttcttttaaaagaaatttcaaactagataatagttgttctcctccccacccccgccaccagtagtgtggtggggcagcagagttgtggctagtggaggagagcagaggaggagagtagggaaaggagaatgccatttgcctacatttccctctgcccatttcccgctgcccatttccccccttgttttcctgaacgtgaactgagctctgggcactgttttaggcctagcaggggacaggataaagcctgcttctctaggaattcgcactgagggtgtgagtgtgtgcacgtgtgtgtttggaggcgggagaataaacacaaataaataaaaaggagaatttcaggcagtgataagagtgctgagaaaaacagaacggtgtgaaagaggaaggctgagcctgcagaggcttgaggctgctgccactgggtagcggtaggcctttccgaggaggcggcatttgaagaccggaggaaggttcatcccagcaagtaggaacagcaagtgtaggtcccctaagtcttgggggagcttagttcctttaagggcagcacaaaaatcagtgtggctccggagagcacattaggggagagaggcaggaagagcttggagacatggatggaagctggaccagttgggccttgttgaacatggaaaggcatttagatcgtattctgagttaaatgggaagtgacgtgagagatttaacaatggagcgtcttgaactgctttactcatttaaaatacccactcctgcttggctgaatatctcatgttgtctttttagaagctttggcgatcctatttgaatgcatttaggtcctattggaggggaataggatctcatttgaggccacggaggtccatggaagtcacctgcatagcaaataccctgaaagtggctgcagggagagtgtgagggtgggaccgccctggtaggaggtggaaaatgaaaaacacacggccatgagttccagattagggcttctgaaagccctcagctttcccagctcccatcctaaagtgggtctttaaacaggaagaaagaaagattgctaagtgtctttggagttcctcttccttccccttctagggatttcagcactcctggggctcgggttggctctaaagtagtcctttctgtgtcttcccacctacagtaacaaaggcatggagcatctgtacagcatgaagtgcaagaacgtggtgcccctctatgacctgctgctggagatgctggacgcccaccgcctacatgcgcccactagccgtggaggggcatccgtggaggagacggaccaaagccacttggccactgcgggctctacttcatcgcattccttgcaaaagtattacatcacgggggaggcagagggtttccctgccacggtctgagagctccctggctcccacacggttcagataatccctgctgcattttaccctcatcatgcaccactttagccaaattctgtctcctgcatacactccggcatgcatccaacaccaatggctttctagatgagtggccattcatttgcttgctcagttcttagtggcacatcttctgtcttctgttgggaacagccaaagggattccaaggctaaatctttgtaacagctctctttcccccttgctatgttactaagcgtgaggattcccgtagctcttcacagctgaactcagtctatgggttggggctcagataactctgtgcatttaagctacttgtagagacccaggcctggagagtagacattttgcctctgataagcactttttaaatggctctaagaataagccacagcaaagaatttaaagtggctcctttaattggtgacttggagaaagctaggtcaagggtttattatagcaccctcttgtattcctatggcaatgcatccttttatgaaagtggtacaccttaaagcttttatatgactgtagcagagtatctggtgattgtcaattcattccccctataggaatacaaggggcacacagggaaggcagatcccctagttggcaagactattttaacttgatacactgcagattcagatgtgctgaaagctctgcctctggctttccggtcatgggttccagttaattcatgcctcccatggacctatggagagcagcaagttgatcttagttaagtctccctatatgagggataagttcctgatttttgtttttatttttgtgttacaaaagaaagccctccctccctgaacttgcagtaaggtcagcttcaggacctgttccagtgggcactgtacttggatcttcccggcgtgtgtgtgccttacacaggggtgaactgttcactgtggtgatgcatgatgagggtaaatggtagttgaaaggagcaggggccctggtgttgcatttagccctggggcatggagctgaacagtacttgtgcaggattgttgtggctactagagaacaagagggaaagtagggcagaaactggatacagttctgaggcacagccagacttgctcagggtggccctgccacaggctgcagctacctaggaacattccttgcagaccccgcattgccctttgggggtgccctgggatccctggggtagtccagctcttcttcatttcccagcgtggccctggttggaagaagcagctgtcacagctgctgtagacagctgtgttcctacaattggcccagcaccctggggcacgggagaagggtggggaccgttgctgtcactactcaggctgactggggcctggtcagattacgtatgcccttggtggtttagagataatccaaaatcagggtttggtttggggaagaaaatcctcccccttcctcccccgccccgttccctaccgcctccactcctgccagctcatttccttcaatttcctttgacctataggctaaaaaagaaaggctcattccagccacagggcagccttccctgggcctttgcttctctagcacaattatgggttacttcctttttcttaacaaaaaagaatgtttgatttcctctgggtgaccttattgtctgtaattgaaaccctattgagaggtgatgtctgtgttagccaatgacccaggtgagctgctcgggcttctcttggtatgtcttgtttggaaaagtggatttcattcatttctgattgtccagttaagtgatcaccaaaggactgagaatctgggagggcaaaaaaaaaaaaaaagtttttatgtgcacttaaatttggggacaattttatgtatctgtgttaaggatatgtttaagaacataattcttttgttgctgtttgtttaagaagcaccttagtttgtttaagaagcaccttatatagtataatatatatttttttgaaattacattgcttgtttatcagacaattgaatgtagtaattctgttctggatttaatttgactgggttaacatgcaaaaaccaaggaaaaatatttagtttttttttttttttttgtatacttttcaagctaccttgtcatgtatacagtcatttatgcctaaagcctggtgattattcatttaaatgaagatcacatttcatatcaacttttgtatccacagtagacaaaatagcac

SEQ ID NO: 62 - DNA, 18 bp, Homo Sapiens
cagggaagctggaatgag

SEQ ID NO: 63 - DNA, 18 bp, Homo Sapiens
tccctcccagagagtgcc

SEQ ID NO: 64 - DNA, 17 bp, Homo Sapiens
ccagctccaccaccagc

SEQ ID NO: 65 - DNA, 18 bp, Homo Sapiens
agggctctaggccaggtc

SEQ ID NO: 66 - DNA, 20 bp, Homo Sapiens
agaacccatcgtataaaaag

SEQ ID NO: 67 - DNA, 16 bp, Homo Sapiens
ggacgtcgatggtatt

SEQ ID NO: 68 - DNA, 16 bp, Homo Sapiens
aacggtgtcgtcgaaa

SEQ ID NO: 69 - DNA, 16 bp, Homo Sapiens
cacgcagttgcgcgct

SEQ ID NO: 70 - DNA, 16 bp, Homo Sapiens
ttttgtgcgcacggac

SEQ ID NO: 71 - DNA, 16 bp, Homo Sapiens
ttaagcgggcgctgat

SEQ ID NO: 72 - DNA, 16 bp, Homo Sapiens
tagaggcgcgggttac

SEQ ID NO: 73 - DNA, 17 bp, Homo Sapiens
cttcgactcggctcaga

SEQ ID NO: 74 - DNA, 16 bp, Homo Sapiens
caatggggcgccgact

SEQ ID NO: 75 - DNA, 16 bp, Homo Sapiens
caccgcagcggccagg

SEQ ID NO: 76 - DNA, 16 bp, Homo Sapiens
aggaacgccagccgtt

SEQ ID NO: 77 - DNA, 17 bp, Homo Sapiens
ggccgccgcaccatgga

SEQ ID NO: 78 - DNA, 16 bp, Homo Sapiens
acagtaaacgcgagga

SEQ ID NO: 79 - DNA, 16 bp, Homo Sapiens
ccccgtggcggagaac

SEQ ID NO: 80 - DNA, 16 bp, Homo Sapiens
cacggacaccccggcc

SEQ ID NO: 81 - DNA, 16 bp, Homo Sapiens
ccacgactcgcaggcc

SEQ ID NO: 82 - DNA, 16 bp, Homo Sapiens
gaagccaccgcgctgg

SEQ ID NO: 83 - DNA, 16 bp, Homo Sapiens
gaccgatgcggtccat

SEQ ID NO: 84 - DNA, 16 bp, Homo Sapiens
gtccggcgggaggaga

SEQ ID NO: 85 - DNA, 17 bp, Homo Sapiens
agccgattcccgcccag

SEQ ID NO: 86 - DNA, 16 bp, Homo Sapiens
ggaagagccgcgggcc

SEQ ID NO: 87 - DNA, 20 bp, Homo Sapiens
acatacagtaattcttgagg

SEQ ID NO: 88 - DNA, 19 bp, Homo Sapiens
agaatgagtaaaagcctgt

SEQ ID NO: 89 - DNA, 18 bp, Homo Sapiens
aaatattttactcctcaa

SEQ ID NO: 90 - DNA, 18 bp, Homo Sapiens
aaagtcccccaaaattat

SEQ ID NO: 91 - DNA, 16 bp, Homo Sapiens
agcccccaaatgacct

SEQ ID NO: 92 - DNA, 16 bp, Homo Sapiens
ccaccactatgcgcag

SEQ ID NO: 93 - DNA, 16 bp, Homo Sapiens
acgctgcacatccagg

SEQ ID NO: 94 - DNA, 16 bp, Homo Sapiens
ggctcgccgggtgatg

SEQ ID NO: 95 - DNA, 17 bp, Homo Sapiens
gacagcatccttgggca

SEQ ID NO: 96 - DNA, 17 bp, Homo Sapiens
gcaaggagggtggcttc

SEQ ID NO: 97 - DNA, 16 bp, Homo Sapiens
aaaccaaaccttgata

SEQ ID NO: 98 - DNA, 16 bp, Homo Sapiens
tcttgagcacatggga

SEQ ID NO: 99 - DNA, 16 bp, Homo Sapiens
agctggacagtcgcca

SEQ ID NO: 100 - DNA, 16 bp, Homo Sapiens
ggaggaatcctgcatt

SEQ ID NO: 101 - DNA, 16 bp, Homo Sapiens
gtggaaggaagaaagc

SEQ ID NO: 102 - DNA, 16 bp, Homo Sapiens
gacacgattacatagc

SEQ ID NO: 103 - DNA, 16 bp, Homo Sapiens
gcggggctggcgtaac

SEQ ID NO: 104 - DNA, 16 bp, Homo Sapiens
cgcctactccggggct

SEQ ID NO: 105 - DNA, 16 bp, Homo Sapiens
ccataggcgccctccc

SEQ ID NO: 106 - DNA, 17 bp, Homo Sapiens
taggctgtagggggatg

SEQ ID NO: 107 - DNA, 16 bp, Homo Sapiens
ctctagggatttacag

SEQ ID NO: 108 - DNA, 20 bp, Homo Sapiens
tggaagcaacagcagcatct

SEQ ID NO: 109 - DNA, 16 bp, Homo Sapiens
accaatcgccgctcgg

SEQ ID NO: 110 - DNA, 16 bp, Homo Sapiens
caatcgtcagcggcgg

SEQ ID NO: 111 - DNA, 16 bp, Homo Sapiens
gtcgtcctcgcgagga

SEQ ID NO: 112 - DNA, 16 bp, Homo Sapiens
caatgagcgcgctgta

SEQ ID NO: 113 - DNA, 16 bp, Homo Sapiens
gccacagccagcaacg

SEQ ID NO: 114 - DNA, 16 bp, Homo Sapiens
ggccctggccacgggc

SEQ ID NO: 115 - DNA, 16 bp, Homo Sapiens
ctgtcctccttaacag

SEQ ID NO: 116 - DNA, 18 bp, Homo Sapiens
gccccaacccaacctgtc

SEQ ID NO: 117 - DNA, 16 bp, Homo Sapiens
aaaacgtggacgtttt

SEQ ID NO: 118 - DNA, 17 bp, Homo Sapiens
tgaaagtcggccaaagc

SEQ ID NO: 119 - DNA, 16 bp, Homo Sapiens
ctggacgtcgaggaga

SEQ ID NO: 120 - DNA, 16 bp, Homo Sapiens
ctctcgggcggagaga

SEQ ID NO: 121 - DNA, 17 bp, Homo Sapiens
ttcggccagccccgcat

SEQ ID NO: 122 - DNA, 17 bp, Homo Sapiens
cccgggccaccacgctt

SEQ ID NO: 123 - DNA, 16 bp, Homo Sapiens
cccagtcgcgcagcgc

SEQ ID NO: 124 - DNA, 16 bp, Homo Sapiens
aacccgcgagcttaga

SEQ ID NO: 125 - DNA, 16 bp, Homo Sapiens
tgtgagaacggctgca

SEQ ID NO: 126 - DNA, 16 bp, Homo Sapiens
ccaggcgtcccggcgc

SEQ ID NO: 127 - DNA, 16 bp, Homo Sapiens
caggcctgcgcgaaga

SEQ ID NO: 128 - DNA, 17 bp, Homo Sapiens
ggcagccgggctggcac

SEQ ID NO: 129 - DNA, 16 bp, Homo Sapiens
cagggctggaagccgc

SEQ ID NO: 130 - DNA, 16 bp, Homo Sapiens
agtggaagctctaggt

SEQ ID NO: 131 - DNA, 18 bp, Homo Sapiens
ccggagccacttcccgat

SEQ ID NO: 132 - DNA, 16 bp, Homo Sapiens
cttaaaccgatggcct

SEQ ID NO: 133 - DNA, 16 bp, Homo Sapiens
taggtgctggagccac

SEQ ID NO: 134 - DNA, 16 bp, Homo Sapiens
agacagaatggaggtg

SEQ ID NO: 135 - DNA, 16 bp, Homo Sapiens
ggcgctccccattccc

SEQ ID NO: 136 - DNA, 17 bp, Homo Sapiens
acttcgaggatcacgtc

SEQ ID NO: 137 - DNA, 17 bp, Homo Sapiens
agatggcgctccccgca

SEQ ID NO: 138 - DNA, 18 bp, Homo Sapiens
accctcgaaccgactcct

SEQ ID NO: 139 - DNA, 16 bp, Homo Sapiens
agcccgacggtctcag

SEQ ID NO: 140 - DNA, 16 bp, Homo Sapiens
agcccacgtgaccgag

SEQ ID NO: 141 - DNA, 16 bp, Homo Sapiens
ctacgagaagcgggta

SEQ ID NO: 142 - DNA, 16 bp, Homo Sapiens
agggggcgactcccgg

SEQ ID NO: 143 - DNA, 16 bp, Homo Sapiens
ttagcgccgcttgacc

SEQ ID NO: 144 - DNA, 17 bp, Homo Sapiens
agcccgcctcattgcgc

SEQ ID NO: 145 - DNA, 17 bp, Homo Sapiens
gcccacagaaagacacc

SEQ ID NO: 146 - DNA, 16 bp, Homo Sapiens
tgtgtgtgtgattgcc

SEQ ID NO: 147 - DNA, 17 bp, Homo Sapiens
tctgtataaaatagttt

SEQ ID NO: 148 - DNA, 16 bp, Homo Sapiens
gttctgtactgtgact

SEQ ID NO: 149 - DNA, 17 bp, Homo Sapiens
tgtagtcctccccaggg

SEQ ID NO: 150 - DNA, 20 bp, Homo Sapiens
ctcttcctatatgtataccc

SEQ ID NO: 151 - DNA, 16 bp, Homo Sapiens
agaggaagaaactgag

SEQ ID NO: 152 - DNA, 16 bp, Homo Sapiens
agagaatctcagaagg

SEQ ID NO: 153 - DNA, 16 bp, Homo Sapiens
agccgggagagcgaaa

SEQ ID NO: 154 - DNA, 17 bp, Homo Sapiens
aagagtcgggagccgga

SEQ ID NO: 155 - DNA, 16 bp, Homo Sapiens
ggccgaagagtcggga

SEQ ID NO: 156 - DNA, 16 bp, Homo Sapiens
atgccagcgggccgaa

SEQ ID NO: 157 - DNA, 17 bp, Homo Sapiens
gagcggtaggtgtcgaa

SEQ ID NO: 158 - DNA, 16 bp, Homo Sapiens
agtccgcagtcccgag

SEQ ID NO: 159 - DNA, 16 bp, Homo Sapiens
cagggcgcggagcaga

SEQ ID NO: 160 - DNA, 16 bp, Homo Sapiens
catccgcgggcggctc

SEQ ID NO: 161 - DNA, 16 bp, Homo Sapiens
attcggcgggagatca

SEQ ID NO: 162 - DNA, 17 bp, Homo Sapiens
agatcagccgaaagagc

SEQ ID NO: 163 - DNA, 18 bp, Homo Sapiens
tacatcccggggtcccaa

SEQ ID NO: 164 - DNA, 17 bp, Homo Sapiens
actcctctcataaaata

SEQ ID NO: 165 - DNA, 16 bp, Homo Sapiens
gcagatattaggtgaa

SEQ ID NO: 166 - DNA, 17 bp, Homo Sapiens
caaggaaaccctaaatc

SEQ ID NO: 167 - DNA, 16 bp, Homo Sapiens
atagccctaggtcttc

SEQ ID NO: 168 - DNA, 17 bp, Homo Sapiens
ccccgggcccaagacga

SEQ ID NO: 169 - DNA, 16 bp, Homo Sapiens
aggggcctgaaggtgg

SEQ ID NO: 170 - DNA, 17 bp, Homo Sapiens
atttggaggttccggtt

SEQ ID NO: 171 - DNA, 16 bp, Homo Sapiens
ctccgagatttttact

SEQ ID NO: 172 - DNA, 16 bp, Homo Sapiens
tgaaacaacagtccta

SEQ ID NO: 173 - DNA, 16 bp, Homo Sapiens
cccctgcagggccccc

SEQ ID NO: 174 - DNA, 16 bp, Homo Sapiens
gcagaagagatatctt

SEQ ID NO: 175 - DNA, 18 bp, Homo Sapiens
accctacaccgacaccgg

SEQ ID NO: 176 - DNA, 16 bp, Homo Sapiens
tttgagatcttgacta

SEQ ID NO: 177 - DNA, 16 bp, Homo Sapiens
tattgtgacatcatcg

SEQ ID NO: 178 - DNA, 16 bp, Homo Sapiens
tccctcactgtgtgcg

SEQ ID NO: 179 - DNA, 16 bp, Homo Sapiens
tggatagctcagaacc

SEQ ID NO: 180 - DNA, 16 bp, Homo Sapiens
cctcttcctcaggttt

SEQ ID NO: 181 - DNA, 16 bp, Homo Sapiens
ccccagcccacccacc

SEQ ID NO: 182 - DNA, 16 bp, Homo Sapiens
gaacacaccttggggc

SEQ ID NO: 183 - DNA, 17 bp, Homo Sapiens
gcactcagccgtatagt

SEQ ID NO: 184 - DNA, 16 bp, Homo Sapiens
catttgtcgcgttgat

SEQ ID NO: 185 - DNA, 16 bp, Homo Sapiens
tgcaattcggggactc

SEQ ID NO: 186 - DNA, 16 bp, Homo Sapiens
aggaagcacggagaat

SEQ ID NO: 187 - DNA, 17 bp, Homo Sapiens
tccgctggagatcgcgc

SEQ ID NO: 188 - DNA, 16 bp, Homo Sapiens
ttgcggaagcacgcgg

SEQ ID NO: 189 - DNA, 16 bp, Homo Sapiens
caaactcgacgggccc

SEQ ID NO: 190 - DNA, 16 bp, Homo Sapiens
ttctcgcccggcggag

SEQ ID NO: 191 - DNA, 16 bp, Homo Sapiens
cccgcgtccatcgtgt

SEQ ID NO: 192 - DNA, 16 bp, Homo Sapiens
cttcgcggcccgcagt

SEQ ID NO: 193 - DNA, 19 bp, Homo Sapiens
acagtctcgccatctgcat

SEQ ID NO: 194 - DNA, 16 bp, Homo Sapiens
cccagtacggggtgca

SEQ ID NO: 195 - DNA, 18 bp, Homo Sapiens
ggcgtcacagccacgccc

SEQ ID NO: 196 - DNA, 17 bp, Homo Sapiens
tgcccatcgaaggcaga

SEQ ID NO: 197 - DNA, 16 bp, Homo Sapiens
gcgggagcgcctgggg

SEQ ID NO: 198 - DNA, 16 bp, Homo Sapiens
tgggcccggactctgg

SEQ ID NO: 199 - DNA, 16 bp, Homo Sapiens
aagggagaacggaaaa

SEQ ID NO: 200 - DNA, 16 bp, Homo Sapiens
gtctttttaaagaact

SEQ ID NO: 201 - DNA, 16 bp, Homo Sapiens
ctgcccgaagatcgcc

SEQ ID NO: 202 - DNA, 17 bp, Homo Sapiens
cagcgcaaggacccggt

SEQ ID NO: 203 - DNA, 18 bp, Homo Sapiens
agagtccggcttcccgca

SEQ ID NO: 204 - DNA, 18 bp, Homo Sapiens
actcgtacctgcgggcta

SEQ ID NO: 205 - DNA, 16 bp, Homo Sapiens
aactcgaccgcgggca

SEQ ID NO: 206 - DNA, 4200 bp, Artificial Sequence
  chemically treated genomic DNA (Homo sapiens)
gaaaatgagggttggttttgaagttggatagatttgtttgatttgtttgtttttagtttgggttaattatattgttttagtaagttatttatattgtttttatatttttgaaatgaggtatatgtttgttttatttgggaatgcgaggattaaggagaataatatatatataatgttgaatatttacgttttttaattattttgaagttttagaaatatttttagtttttaggtgagttgtgattaaattcgtttattaatttaatatatatttattgaatgtttattttgtgtcgtagtttttggtaggtgtgtttgatagtgggtgtgtaatatgtttagggtttgtattttatgagcgtggggattttttttattttttggtatatatggttttgggggagaagttaaggggaagggttaggagtttatatggtagatttagtaagtttttagtataataattttaattgtaaaaataaatagttttgttaattgtttgagagtagcgtttgttttataaaaattaataataataaaaggaaaaaaaatttaaagtaaaacgttatatttaatggttgttggataagatattgttgtataaagtttcgcgcgagatcgttttggcgttgttttagtttgtttttgggggttatagaggaaggcgtggggcgtgtgttagttataaaagattgttttgaattttagggtagtgtttatttattgggtggttttagaagattttttttaaagcgcggttgataagggtgatagcgtttggatcgcgggaattgttcgcggagttggtgttgaatagggcgtgtgcggcgggcgttttaaggaaattggaagcgggatcggaggtcggttttcgggcgtgcgaggaggagttggaagaagagcggggaggggaacggttcggaattcgtgcgcgtcgaacggcggcgttttaatttataaatttattttttgtttagagagaagcgaaggagaggtttagcgagtaaaagtcgaggtttttgagtcgtttttcggcgcgcgttttttgtttgaggtgtattttgttgtgtcgtttttttttatcgttgcgcgcgaagcggcggtcgtatacgtcgtaagtaaaaggtttttcgtcggtgtgggtgcgtacgtgcgtggtgaggtggtcgttgcggttgaagttgcggaggtagatgcggtattggaagggtttgtggttcgtgtggatgcgtaggtggcgattgagttcgtcggagcgcgtaaagtttcgtatataattttttatcgggtaagcgaaggttttggcgtgcggtcgcgggtagaagtagcgcgtgttgtatttgtcgtcgcggcgttttttgcgtcgcgttttggtttgggggaaaggggtgggcggcggcggcggtacgggtggtgtagttacgttattgtttttagggatgttcgttattagaggtttagggaagttcgtcgcggcggcgttgcgaaggtttagcggggaaagttgaggttgcgtattggttagaaatttttcgtcgtcgtcgttattttttttttttttattaggaggggttaggagtttagggaggtttttagtttttttttttaagttattcggggttagcgggaaagcgttataggtttcgttgggatagagtttgttggttgggacggtcggtagtttcgtagggtagttgatggatagtaagtttttaattttggtttttattacgggaaaacgagttttcggggcggtttggtagtttttttgtgatttatagttttttggggtttttatagaaagtagtttttagggcgcgtagggatttttgaaggtagagatagcgtttagcgttggcgaggcgggaggcgttcggaggtcgggtttgacgtcgggcggggagagttgaggtttatataggtattgcgagggggtattcgcgtaaggcgaggttttttagaacgtttttgggaaaggggtagcgtttagattcggggagtaaaggttcggcggattcggtagtaaggtatcggatttcgtaggaaaaggggtatttagcggggatttggacgttgttgtttttggatcggggaagggtgttaggtttaagatgttcgatatgaggttgaagagtgttttcgggtcgtgcgggtgttcgggtattgtttgaatgaagaagttatcgttgtagttgaggtcgggagggggtgtgggcgtaggtttttttaggaagtaggagtcggttaagtttttatttgcgtcgtagttgtttaaagtttagtttaagaagtcgtttgttgaggagggagtaggaattagttttgggtatattaaagggtgtatttgagtttatagtttttatttataaaatttttggtgtttacggatatatataaagtgttttttgtatattttgatttagtaggggttcgtatacgttttaaggagtatatagaaatatgtatacgtaaaatatacgtgtataggtaaaagggcgtttcgataatcgtataggtttttgcggaggcgttggcggtttagtgtgggtgggaatgggggtgcgtattttaggatttttaagttttttatcgtttttatttttatagttttaatgttttagttttttttggtttttaggtatggtgcgttttcgcgttgcgtcgtcgtcgtttgagtatttttgttcgttttttttatttttagggtagtcggtggtcgcgggagcgtttttggtaggtagtcggggtaatttagcgttgggttcggcgtaatagtttttagtggatttgacgaggagcgcgtcgggttcggaaaattcgttaaggtggagtatggcgcggcgtcggttgtggggcgttcggggtttcgttcgttgggtttgggggcgcgcgggtggcggggaggttggcggtaggggtttttcgtagcgtatagatttaggcgttcgggtttttggtttcgggtatttatttttgggaaaggagtcggggagtcgcggcgttttcgttcgttcgtatcggtttcgggcggcggtttttcgtttttttaaagcgttgtcgggtttttttagtttatagtttttttatttatatagttgcggcggcgttggtttcgggttttcgatttttcgggttattgttattttgggaggtttcggttttgtcgtcgtgacgtaaatgtttaaatatggatataggatgtgtgtcggggattttcgaaaaggaaagttcgagttgtgacgttgttgttgtcgtcgtcgtcgttaggttcgcgtcgttgcgtgcgcgcgcgttttttaggcgtggagcgttggggtcgcggatgcgttagtttggggcgttgcgttttatcgggtcgatcgttcggtagatgcgttttttatttggaggtagaggtcgaggggtagtaggggaggatcgtgttgggtttgaatttgttttttgttattaattagtttgatatttagttttttttaacgttagttttttatttgtgtattttttgtggagagaaattgagagtatataaatgtttaggcgtatttagtaaattatagagattattgttatttattttttttgtttacgtttgtgtgtttttttattttaagttttttttttttaaatttgtgttaggaaaaataatttaaattaaaaaggattgtaatatttgttaatagtaggaggaaagttaattagtataatagggtatattttaaattgaaaagtaaaagttttttttttttatttatttttatttttagtttttgaggtagttatatttaagttttttgggtatttttttagaagaattttatgtatatttaattatatatattgttttgtaatattattattattattatttttttatttgaaataatttagagattgtgttatgttttgatataaagattttgttatttttttttaaggttgtatagtattttattgtaagggaggattttgagttagtcgatttgttttttatttatgagtatgtaggtagtttttaattttttatttatattaatgttgttggagttaatatttttgattatataaatgtgaatgtgtttgtgagataaattttaacgagtgtaattgtgtgttaaagtatatgtaaaattttgatagataattggtaaattgttttttagaaaagtagggttaatttttgtttattttttttttatttat

SEQ ID NO: 207 - DNA, 4200 bp, Artificial Sequence
  chemically treated genomic DNA (Homo sapiens)
gtgggtgagggaggagtgagtaggaattggttttatttttttggaagataatttgttagttgtttattaaaattttatatatattttggtatataattatattcgttggaatttattttatagatatatttatatttatatagttaaggatgttgattttaataatattggtataagtaaaaagttggaaattgtttatatgtttatggataggggataaatcgattaatttaaggtttttttttataatggagtattatatagttttgaaaaagaatgataagatttttatgttaggatatggtataatttttaagttattttaagtgaaaaaataataataataataatattgtagaataatgtgtatggttggatatatataaaatttttttgaaagaatatttaagaaatttaaatgtggttattttaggagttaggaatgaaggtaggtggagaggagggatttttattttttaatttagaatatattttgttgtgttagttgattttttttttattgttaataagtattatagttttttttaatttaaattattttttttagtataaatttaaaaaaaaaaaatttaaaatggaaaaatatataggcgtgagtaaaagaaatgaatggtaataatttttgtggtttattgagtgcgtttggatatttatgtgtttttagtttttttttataggaaatgtataggtgagaaattgacgttaagggggattgagtgttaagttagttagtggtagagggtagatttaaatttaatacggtttttttttgttgtttttcggtttttgtttttaggtgggaagcgtatttatcggacggtcggttcggtgaggcgtagcgttttagattggcgtattcgcggttttagcgttttacgtttggggagcgcgcgcgtacgtagcggcgcgagtttggcggcggcggcgataataataacgttatagttcgagttttttttttcgggagttttcggtatatattttgtgtttatgtttgggtatttacgttacggcggtagggtcggggttttttaaaatggtagtggttcggggagtcggaagttcggagttagcgtcgtcgtagttatataagtgggggggttgtgggttgggggagttcggtagcgttttggagaggcgaggagtcgtcgttcgaggtcggtgcgggcgagcgagggcgtcgcggtttttcgattttttttttagaggtgagtgttcgaagttaggagttcgggcgtttaggtttgtgcgttgcggggaatttttatcgttagttttttcgttattcgcgcgtttttaagtttagcgggcgaggtttcgggcgttttatagtcggcgtcgcgttatgttttattttagcgagtttttcgaattcgacgcgtttttcgttaagtttattgaaggttgttgcgtcgaatttagcgttgaattgtttcggttgtttgttagggacgttttcgcggttatcggttattttggaggtaaggagggcgagtaggggtgtttagacgacgacggcgtagcgcgggggcgtattatatttgagaattaggagggattgggatattggagttatgagaataggggcgatgggaagtttaggagttttggggtgcgtatttttatttttatttatattgggtcgttagcgttttcgtaggaatttgtgcggttatcggagcgtttttttgtttgtgtacgtgtgttttgcgtgtgtatgtttttatgtgttttttgggacgtatgcgggtttttgttgaattagaatgtgtaaaaggtattttgtgtatattcgtgggtattaagagttttgtaggtaggggttgtggatttaggtgtattttttgatgtgtttagagttgatttttgttttttttttagtaggcgattttttgagttgggttttgaatagttgcggcgtaagtggggatttagtcgatttttgttttttggaggggtttgcgtttatattttttttcggttttagttatagcggtagtttttttatttaggtagtgttcgaatattcgtacgattcggaggtattttttaattttatgtcgggtattttaggtttggtattttttttcggtttagaggtagtagcgtttagattttcgttggatgtttttttttttgcggggttcgatgttttgttgtcgggttcgtcggatttttatttttcggatttgggcgttgttttttttttagaggcgttttgggaggtttcgttttgcgcgggtgttttttcgtagtgtttgtatgagttttagtttttttcgttcgacgttaagttcggttttcgggcgtttttcgtttcgttagcgttggacgttgtttttgtttttaagggtttttacgcgttttgggagttgttttttgtgggggttttagggaattgtgggttatagggagattattaggtcgtttcggaggttcgttttttcgtaatagggattaagattgaggatttgttgtttattagttgttttgcggaattgtcggtcgttttagttaatagattttattttagcggggtttatgacgttttttcgttggtttcgggtgatttaggggagggggttgagggtttttttgggtttttgattttttttagtggggagggagggagtagcggcgacggcggagagtttttggttagtacgtagttttagtttttttcgttgggttttcgtagcgtcgtcgcggcggatttttttaaatttttggtggcggatatttttggaagtagtggcgtggttgtattattcgtgtcgtcgtcgtcgtttattttttttttttaggttaaggcgcgacgtaaggggcgtcgcggcggtaaatgtagtacgcgttgtttttgttcgcggtcgtacgttaaggttttcgtttgttcggtggagagttgtgtgcggagttttgcgcgtttcgacgagtttaatcgttatttgcgtatttatacgggttataaatttttttagtgtcgtatttgttttcgtaattttagtcgtagcgattattttattacgtacgtgcgtatttatatcggcgagaagttttttgtttgcgacgtgtgcggtcgtcgtttcgcgcgtagcgatgagaagaaacggtatagtaaggtgtattttaagtagaaggcgcgcgtcgaggagcggtttaagggtttcggtttttattcgttgggtttttttttcgtttttttttgagtaagagatgggtttatgggttggggcgtcgtcgttcggcgcgtacgagtttcgggtcgttttttttttcgttttttttttaattttttttcgtacgttcgagggtcggttttcggtttcgtttttagtttttttgaagcgttcgtcgtatacgttttatttagtattagtttcgcggatagttttcgcggtttaggcgttgttatttttgttagtcgcgttttgggggaagttttttgagattatttagtgaataggtattattttgggatttaagatagttttttgtaattggtatacgttttacgtttttttttataatttttagagataggttggggtagcgttaaggcggtttcgcgcgggattttgtatagtagtgttttatttagtagttattggatgtaacgttttgttttgggttttttttttttttgttgttgttaatttttgtaaagtagacgttatttttaagtagttgataaaattgtttatttttgtaattaaaattattgtgttaaaagtttattgaatttgttatgtaagtttttgatttttttttttagttttttttttaggattatatgtgttagaagataaaggagatttttacgtttatgggatatagattttgaatatattatatatttattgttaggtatatttgttaggaattgcggtatagagtaggtatttagtaaatgtgtgttgggttaatgaacgaatttaattatagtttatttaagggttggaggtgtttttggaattttaaagtggttaaaaggcgtaggtgtttaatattatgtatatattattttttttaattttcgtatttttaaataaagtaggtatatattttattttaaagatgtggaagtaatgtagatagtttgttggaataatgtagttaatttaggttaggaatagataggttaaataaatttgtttaattttaaagttaatttttattttt

SEQ ID NO: 208 - DNA, 4491 bp, Artificial Sequence
  chemically treated genomic DNA (Homo sapiens)
tttagtaattttttatgttgaaatttggtttagtatattttgattatatatttatatttaattatagttttaaaatagttaagtagttttaaaaatttaaattaaatttttgtggaatttttaaaaataagaaaaatattattgagtaattggtaatataaaatataaaatgtttaatttggtttttttttagatttgaagtatagtgattaatgaatatataatggtcgtagttttttttataattatgttatttaagttattgatgaatatttatgatatatgtagtaaaaatttagataaatattttggttataaattggtttattaaataatagtttgtattatagtttgagttaagagtaataggtttataattgtgttttagggtattaagaagtttttttgaggattttttaaaaggtattttttgttttgaaagattgttttttttttggaagttttaggttttatgagaaattatttattttgaatttgttataaaaaatgatttgtaaataagttttgtgtagtgaattatgtgtttttagtaagaggattttgaaagttttttgtaaaatgaagttatttttaaaagagagttatttagaatataattaaattgatttatatgtttttatttattttaaatatgaagggaaattgtttttaaatatatttaaatttttaatagaatagtagtatgttattagtgtggaaataatttatttgttaaataaatatttggggtgtatttgttgtatattaggtattgtaatatagggattaatgaaagagaaaaaaaataaagtacgaaaggatagtagaaatagttttataattttattttttaggaataatttttatggatattttgttgtgtgtttattgtttttttaatatatatattttttaattaaatggaattgttttaaatatgttatttaatagtttgtttttttttatattatttgaaaattaagaaacgattataatatgttttatttaaaaattttaagtttaggtcgggtatagtggtttacgtatgtaattttagtatttggagggatcgaggtgggcggattataaggttaggagattgagattattttggttagtatggtgaaatttcgtttttattaaaaatataaaatttagttgggtatgatggtacgtgtttgtagttttagttatttgggaggttgaggtaggagaatcgtttgaattcgggaggtggaggttgtagtgagcggagattgtattattgtattcgtttggtgatagagtaagattttattttaaaaaataaataaagaaaatttgaagtatagtatttttttaaattttaaatagataatagaaattggtttttttttatttaaattagaatttaagtttaattttatatatttttgatagtttggattttgttttttaattttataaaattgggaatttaagtattatttggttcgatttaaatgtaatgtagaatttgtattaaaatattatattaaagttttagatttgtagtagttaatagtatttttatgtatgtgttagggattgttttaaatattttatatatattaatttttttattttgtatttttgttttcgttttatatagtaggaaattgaaatattgagaggttaagtaattaaagttatagagttagagtgataggagtaaagttttaatttaggtaatttagatttttagagttttgatttttattattaagttgttagtatagtttttttggtaattatttttaatttaaatataattcgagtgatttatttaataagttattattttgataatttagtgatttgtaatgtaaaattatttattgtaatttatttaatattattgtttttttgtgttgtaaaaattatagtaatcgagatgtaatttattatttttttttttattttcggtattttgtgttaatttttttgttttgcggatttttttcgattttttattatgcgtgttaattgttattaatttttttgtttgttggggattggggtcgcgagggtatattttcgaggggtacggggttagggttaggtaggttgtgcggttgggcggggttttgtgttttattgcggagtgcgggtcgggaagcggagagagaagtagttgtgtaattcgttggatgcggattagggcgttttttattttcgtcgggagttcgtcgattggttgggtgtgggcgtacgtgatcgatatgtggttgtattggtgtagttcgttagggtgttattggagatagaatggaggtgttgtcggattcggaaatggggtaggtgttggagttattatggttaggtttgttgcggggggaggggggaaggtggttttttttcgtattgttttaaatcgatggtttttttttggtatagggtttattgtagtatgttaaacgaggaggtaggggcgtcgttttttcgttttttattgtagtattggagatggattttttgtatttcggatttagggtttttgatagaagaggaagaagggggaggggtagaagtgttaaggggagtttgttgagaaaagttgtttttgaagttagaaggggtttttgtttttataatgttatttgatagagtggaataatagtatttaaggaaacgggtagaggataataaagaatggagtatatttatggcgaggagtaaaagttttattttattgaaaggtttttttttttttttggcgataaggatatatgtattggtggttaaaagagagaggagataaaatcgttgtagatggttgatgtgaatttagtggaaagagttattggggatgagagaaagaggaggaggtaggtattgtagagcgtgagtggtggtgttggttggtgaaatattggttattagtagtgtgtttgtttttgtaaaatatttaagtaaattttttgtgaatagggtggtaaatagatattagtgtttttgttagttataaaatgtagtggtagtggttttttgcggacgattgtagtagtgttttttttttttttgttaggtcgaaaagataattgtagaggaataagaaattttgtagtaaatgttggggtagaagtttatttataagaagttatagtttataaatgtagtttgaatagtagaaaaaaaattattgttttttaaagtaggaataatgttaggttatgaatgttttgttattggaatgtattggatattttgattttatattacgaaagtgatgtttaaattttttgatttaatataaattttatacgaaattttaataaattatgtatgaaatagtggatttttttttttgttagtgaagtttttatgttattaattaggttatttaagagtaaattattttataacgtaaattattttgttaaaaattatggtgaataaatttttgtaggtttaatatttaagatttatagttaagtaattttatatttttttttggttgtttttagataatattgaataaatatttaagatattaatttagtgtgtaaatattttaaattaaagtaatatggttttttttttagatgtatttttgtttagtgagtatttatgagatatatttttgatataaagtgttttttattgagttttttttttttttatttaaatgtaaaagtttatttttatgtatatttatagtagttagtttgttatatttttttattttttgaataaggatggtagtggttttgtaaagttttttagggttagtgatagtgttttttaaataatgtttatgtaatagaaagttttaagatgatttattatattgttttagtaatatttttaagataatgcggaattgggttggtttagataaataagattatataagttttttattgataaatttaaatagttttttaaaaaattatttttgttttaagaattatttgattatggatattagggttaatagtatttaggagtcgggcgtggtggtttatgtttgtaatataagttaaataggaggttgagggaagttgaggtaggaggattatttgagttttggcgtttaagattagtttgggtaattaagtaagattttattttaaaaaaaagtatttagagttttttttttaaaatttgatggaaattatggttagaattaaagatgttatattaaaattttaaatgatatttaatagttaatattatttagttttttgaattttattagtatagtgtttgagagtttataaaattattatttttatataaattattttttattattttaatagtttattgtagtattatttttattttaaatgttagagatttttatttaagtatgttgtgattttatttaaggttaaatattgtataataatgtaaagaatttaagttttttattttattttaattttataaaattataatgttttttattatatatatataaaataatatataatagaggtaatttgaaaaatagtgtaagttattgat

SEQ ID NO: 209 - DNA, 4491 bp, Artificial Sequence
  chemically treated genomic DNA (Homo sapiens)
gttagtgatttatattgttttttaaattatttttgttatatattattttgtatgtatgtaataaaaggtattatagttttatagaattagaataaaatagaagatttaagttttttatattgttatataatatttgattttggataaagttataatatatttgaataggagtttttaatatttaaaataaaaataatgttataatgagttgttaaaatggtaaaaggtaatttatgtaaaaataatagttttatagatttttaaatattatgttaatggaatttaaagaattgagtaatattagttgttaaatgttatttggaattttaatgtgatatttttagttttagttatagtttttattagattttaaaaaagagattttaagtatttttttttgagatagggttttgtttggttgtttaggttggttttgaacgttaaggtttaagtgatttttttgttttagttttttttagttttttgtttagtttgtattataggtatgggttattacgttcggtttttaagtattattaattttgatatttatgattaagtaatttttaaagtagaaataattttttaaagaattatttaaatttattagtgaaaaatttatgtagttttatttatttaagttagtttaatttcgtattattttgaaaatattattgaaataatataataggttattttaagattttttattatataaatattatttaagagatattgttattgattttggagggttttataaagttattgttatttttgtttagggagtggggaggtgtggtaggttggttattataagtatgtataaagataggtttttatatttaggtaaaggaaaaaaaagtttaatgaaaaatattttatattaagagtatattttatgagtatttattaaatagaaatatatttagaagaaaagttatgttgttttaatttaaaatatttgtatattgaattaatattttaaatatttatttagtgttatttaaaagtaattaaagagaaatataaaattatttaattataggttttaaatattaggtttataaaaatttgtttattataatttttgataaagtaatttacgttgtaaagtggtttgtttttgaatgatttaattaatggtataaaagttttattaataaaagaaaagatttattgttttatatataatttattaagatttcgtataggatttatgttaaattaaagaatttgagtattattttcgtgatgtagaattaaagtgtttaatatattttaatgataaaatatttatagtttgatattatttttattttaaaaaatagtaattttttttttgttgtttaggttgtatttataaattatggttttttgtaaatgggtttttattttagtatttgttgtaaggttttttatttttttgtagttgttttttcggtttaatagagggagaaaaagtattgttgtagtcgttcgtaaaaagttattattattgtattttgtaattaataaagatattggtatttgtttgttattttgtttatagggagtttatttagatgttttataaaagtaggtatattattggtgattagtattttattaattaatattattatttacgttttgtagtatttgttttttttttttttttttatttttagtagttttttttattagatttatattagttatttgtagcggttttgtttttttttttttttggttattaatgtatgtgtttttgtcgttagggaggaaaagaagttttttaatggggtagagtttttgtttttcgttatgaatatgttttattttttgttgttttttattcgtttttttagatattgttattttattttgttaaatggtattataaaaataaaaattttttttggttttaaaaatagttttttttagtagattttttttaatatttttatttttttttttttttttttttttgttaaaaattttggattcgaagtataggaaatttatttttagtgttgtagtggggggcggggggacgacgtttttgttttttcgtttggtatgttgtagtggattttgtgttaaggaaaggttatcggtttaagatagtgcgagggaaaattattttttttttttttttcgtagtaagtttggttatggtggttttagtatttattttattttcgagttcggtagtatttttattttgtttttagtgatattttggcgggttgtattaatatagttatatgtcggttacgtgcgtttatatttagttaatcggcgggttttcgacgggaatggggagcgttttggttcgtatttagcggattatatagttgttttttttttcgtttttcgattcgtatttcgtagtggggtatagggtttcgtttaatcgtatagtttgtttagttttagtttcgtatttttcgggggtatgttttcgcggttttagtttttagtaagtaaggaagttgatggtagttgatacgtatagtaaagagtcgggggaggttcgtagggtagaaggattagtataagatgtcggaggtgggagggagagtaataaattatatttcgattgttatgatttttgtagtatagagaaataataatattaaatgaattataatgaataattttatattataagttattgagttgttagagtgatgatttgttagatagattattcgaattatatttgaattaaaaatagttattagaaaagttatgttagtagtttagtagtggagattagaattttggaagtttgggttgtttgagttgaagttttatttttgttattttagttttgtaattttagttatttaattttttagtgttttaattttttgttgtataaaacgggaatagaagtatagaatagaggagttaatatatatgaagtatttagagtagtttttgatatatatatagaagtgttgttagttattataaatttgaggttttaatgtagtattttaatgtaaattttatattgtatttaaatcgaattaggtgatgtttaaatttttaattttatgaggttgaaggataaaatttaaattgttaagaatatataaagttaaatttaaattttggtttaaatggggggaaattagtttttattatttatttaaaatttaaaaggatattatattttaagttttttttgtttgttttttgagatagagttttgttttgttattaggcgagtgtagtggtgtaattttcgtttattgtaatttttatttttcgggtttaagcgatttttttgttttagttttttaagtagttgggattataggtacgtgttattatgtttagttaagttttgtatttttagtagagacggggttttattatgttggttaggatggttttaattttttgattttgtgattcgtttatttcggtttttttaagtattgggattatatgcgtgagttattgtgttcggtttaaatttaaagtttttaaatgaagtatattataatcgttttttaatttttaaatagtatgaaaagaagtaagttattaaatagtatatttgaggtaattttatttgattaaaaaatgtatatattagaaaagtaatagatatataataaaatgtttatagaggttatttttggaaagtgagattatggagttatttttgttgttttttcgtgttttgtttttttttttttttattagtttttgtgttataatgtttgatatatagtaaatatattttaaatatttatttaataagtgagttatttttatattgatggtatattattgttttattaaaagtttaaatatatttagaaataatttttttttatatttgaaataaataaaagtatgtaaattaatttgattatattttaaataatttttttttgagaatgattttattttataaaaggtttttaaaatttttttattgaaagtatatgatttattgtataggatttatttataagttattttttgtgataaatttagaataggtaattttttataaggtttagaatttttagaaggaaaatagttttttaaaataaagaatattttttaaaaggtttttaaaagaattttttagtattttaagatataattgtaagtttattatttttgatttagattatgatataagttattatttagtaaattagtttgtagttaaaatgtttgtttaaatttttattgtatgtattatagatatttattagtgatttaaatgatatagttgtaaagaaagttacgattattatatgtttattagttattatgttttaaatttaaaagaaagttaagttaaatattttgtattttatgttgttaattatttagtaatattttttttatttttagagattttataaaagtttaatttgaatttttaaaattgtttagttattttaaaattataattaaatatagatatataattaaagtatattgggttaaattttagtatggaaaattattgaa

SEQ ID NO: 210 - DNA, 4256 bp, Artificial Sequence
  chemically treated genomic DNA (Homo sapiens)
atattttttaggtttatgatttgagagtttattaaataagagatggttatttttttggtttttaaattattttggaaataaagttatttttagagaggaattttaaaatattgtttgtagttatagtaattttaaaatttgagtgttgtatggtggaagtagataatttattttaggataattgttatttgttatattagtttgaggatggtggtgttaaagaggagttatttatttttaggtatattttatattaaatataaattgtataatttgtttaaattaaggaattatattaaattatattatggttattaaattttgttttgagaaagtgaaattgatttagtttttaaagagataaagagaaagtataagtaaattaaattgtagttataaaaagaaagataaaatgttgtagtatatttattgttttgtgtatttaatgaagtttttcgttttggttataaaattagttttaaaggttttttttatattttatagtatgaaaaatttaaaaagtaatttatatgtaaatatttaaattatgatagaaatttaaagtaaaaagaaaatgaattaattgaattaaaatgtgtaggatgtttaaatttatttgataatatatttatttgataatatattaatatgaatttagtattttaaaatgttatataaataaatgtttttatattaaatattaatgtagttaggattttaagttaatattatttttttttttttatatgtttttttttcgtttttattaaaaattgttaaaattatttattttttttttttttttttgtttttaaataaataaggttttttttaagatattgtaggattataaagttaaattttcgggtttaagttgttggtaaaattttagagatgttaagttatttatgtattaattatttttaaatttttttttaatttttttataaaataggagtagggagaggagaaatatttttgtttaaaaatgaggaattgaaaatttttattataaataaattatattaagtaagttaaagatagtaaaagagtaaaaatgttagtagatatttttaaaatggtaattatatattatttttggaatgattatatgaatgtggtttattattttttaagtttttatagtaaatatatatttatttgttttatttagttaaaaataaatataatatgtagttgtttttgaataatttttttttttttttttttttttttttttttttcgataaagttttattttgttatttaggttggagtgaagtggttttatttcgttgtttattataattttagtttttcgggtttaagcgatttttttgttttaatttttcgagtagttgggattataggcgtttgttattattttcggttattttttgtatttttagtagaggcgaggttttatttgttggttaggttggtttcgaattttcgattttaggtgatttttttcgttttgattttttaaagtgaagggattataaggcgtgaggtatcgcgttcggtcgtttttgaataatttcgattaaaatttatattcgatatttattttaatatatattatagatttttattgataattttttttagtaagaaagataagttttatttaggtatttgtgaattggaggttaagtagttttagtatattttatatttttttaagattttttttttattttaaacgttcgtaaattttgtatttgataaagagtatatttttatttaatataaatatgtttttttttttagatttttttagtattcgagagatttgtacgcgcgtggttttttattttttttttttggttttttaagtttttagggcgtcgttaggaggaggtttgtgattataaattttttttgaaaattttttaggaagtttttttttttttcggagaatcgaagcgttatttgattttaatttttttgtaaatttcgttttttagagtcgttcgttattttttgttttcgttgtagattttttatttatttggatcggttttcgatcgtaattattcggtgcgttgggtagcgttttcgtttttagtagcgttcgtattttttttattcgatttcgggtcgcggtcgtggttagttagttagtcgaaggttttatgttgtttttcgtcgtcggttttatgttgtttttcgtcgttcgttgtttgtttttttttttttcgtagtcgtcgagcgtacgcggttcgttttattttttggtgattagttagtttttttttttttttttttcggtgttggcggaagagtttttttcgattttgttttttaaattttttggagggatcgcggtatttttttaggtaaggggacgtcgtgagcgagtgttcggaggaggtgttattaatttcgagtatttagcgaatgtggtatttttgaagtcgttttaggttgggtttttttcgggggtattagtcggaagtagttttcgttagagttagcgttggtaaggaaggaggattgggtttttttttatttgttttttatatcgtttttcggtttttttgtttttagtcgcgttttttcgtttgttagtaaaggcgtgtttgagtgcgtttattttgttaaaaagaaattcgttttcgtttcgtttttttttttcgcgatataatttttttaattgttaaattgaatcggggtgtttggtgttatagggaaagtatggtttttttttttaattataagaaaaagtaaaattatttttttttagttgtgagagttttatcgagaatcgaaattatttgtacgattagaaagtgtttttttatttttttaatttttgatttttaggagcgcggggtttattaagttagaaattttagtttaaaggattttttttggagagtcggattgtttttttttttttttttttttttttttttgcgtgtaaaacggttgtttggggtaagggttttttagacgtgtatattgtttggtataagagtagattttgaaaagatgaggtttatttaatacggacgggggagaattttgtttgtaggtagataggaaaatggggagggagttattggaaggacggattttatttttaaagttataatttttagattagaaaaagtgtttagtgttttagaagtagagttgtatagtgatttaaagattagttttaaatattgttttgttttttttatattttttatattttttttttttattgaaaatattttgtatttttcgtaattataaagggggaagggaatatgagtgttttttgttttataggggttgttgtgagtttaaatgatgtattaatatatataagttttaagaatagtgttatatattttaagttaatatttgttagtttttgaattattcgttttgaggattggtttgtaattttgttttgaggtatagaaagaaaatgttttggagtaggacgcggtggtttatatttgtaattttagtattttgggaagtcgaggcgggtagattatttgaggttaggagttcgaggttagtttggttaaaatggtgatatttcgtttttattaaaaatataaaaattagttggttatggtggcgtacgtgtgtaattttagttatttaggaggttgaggtaggagaatcgtttgaattcgggaggtagaggttgtagtaagtcgagatcgcgttattattttttagtttgggtgatagaatgagatttcgatttaaaaaaaaaaaaaaaaatgttttggatagaattattattattatataaaaggaaagttcggatgcggtggtttacgtttataattttagtattttgggaggtcgagataggcggattatttgaggttaggagttcgagataagtttgattaatatggcgaaattttgtttttattaaaaaatataaaattagcggggtttggtggcgtatgtttgtaattttagttattcggaggttgatgtaggagaatcgtttgaatttaggagaaggcggaggttgtagtgagtcgagatcgcgttattgtattttagtttgggagataagagcgaaatttggttttaagaaaaaaagaaagaaagaaagaaagaaagattaagaagaatttattttttgaaaagattatgggtattttttattatttttatttataaagaaaagttaaatagtattaaagagtataataagcgtaaggaggtaaaagttttaattttttttgtgattattattttttaagtttattaaaaatatgtattacgtttta

SEQ ID NO: 211 - DNA, 4256 bp, Artificial Sequence
  chemically treated genomic DNA (Homo sapiens)
taaaacgtagtatatgtttttgataagtttaaaaagtagtagttataggaaaaattagaatttttatttttttgcgtttgttatattttttagtgttgtttaatttttttttgtaagtgagggtggtggagggtgtttataatttttttagggagtaagttttttttggttttttttttttttttttttttttttttttttgagattaagtttcgtttttgttttttaggttggagtgtaatggcgcgatttcggtttattgtaattttcgtttttttttgggtttaagcgatttttttatattagttttcgagtagttgggattataggtatgcgttattaagtttcgttaattttgtattttttagtagagatagggtttcgttatgttggttaggtttgtttcgaatttttggttttaggtgattcgtttgtttcggttttttagaatgttgggattatagacgtgagttatcgtattcggattttttttttatgtaatagtgataattttatttaaagtatttttttttttttttttgagtcggagttttattttgttatttaggttggagggtggtggcgcgatttcggtttattgtaatttttgtttttcgggtttaagcgatttttttgttttagttttttgagtagttggaattatatacgtgcgttattatggttagttaatttttgtatttttagtagagacggggtgttattattttggttaagttggtttcgaatttttgattttaggtgatttgttcgtttcggttttttaaagtgttgggattataggtgtgagttatcgcgttttgttttaaagtattttttttttatgttttaaaataagattgtaagttagtttttaaagcggataatttaagagttaataggtattagtttaggatgtgtggtattgtttttaaggtttatatgtattaatatattatttaaatttataataatttttataaagtagggggtatttatatttttttttttttttataattacgaaaaatgtaaggtatttttagtaggaaagagaaatgtgagaagtgtgaaggagataggatagtatttgaagttggtttttggattattgtgtaattttgtttttagaatattgagtattttttttggtttaggaattatgattttgagaatggagttcgtttttttaatgattttttttttatttttttatttgtttataggtagaattttttttcgttcgtattaaataaattttatttttttagagtttgtttttatattaggtaatgtatacgtttgagaaatttttgttttagatagtcgttttatacgtaggaggggaaggggaggggaaggagagagtagttcgattttttaaaaggaattttttgaattagggtttttgatttagtgaatttcgcgtttttgaaaattaagggttgagggggtagggggatattttttagtcgtataggtgatttcgattttcggtggggtttttataattaggaaagaatagttttgtttttttttatgattaaaagaagaagttatattttttttatgatattaaatatttcgatttaatttggtagttaggaaggttgtatcgcggaggaaggaaacggggcgggggcggatttttttttaatagagtgaacgtatttaaatacgtttttgttggtaggcgggggagcgcggttgggagtagggaggtcggagggcggtgtggggggtaggtggggaggagtttagttttttttttttgttaacgttggttttggcgagggttgttttcggttggtgttttcgggggagatttaatttggggcgattttaggggtgttatattcgttaagtgttcggagttaatagtatttttttcgagtattcgtttacggcgtttttttgtttggaaagatatcgcggtttttttagaggatttgagggatagggtcggagggggttttttcgttagtatcggaggaagaaagaggaggggttggttggttattagagggtggggcggatcgcgtgcgttcggcggttgcggagagggggagagtaggtagcgggcggcggggagtagtatggagtcggcggcggggagtagtatggagttttcggttgattggttggttacggtcgcggttcggggtcgggtagaggaggtgcgggcgttgttggaggcgggggcgttgtttaacgtatcgaatagttacggtcggaggtcgatttaggtgggtagagggtttgtagcgggagtaggggatggcgggcgattttggaggacgaagtttgtaggggaattggaattaggtagcgtttcgatttttcggaaaaaggggaggttttttggggagtttttagaaggggtttgtaattatagatttttttttggcgacgttttgggggtttgggaagttaaggaagaggaatgaggagttacgcgcgtatagatttttcgaatgttgagaagatttgaaggggggaatatatttgtattagatggaagtatgttttttattagatataaaatttacgaacgtttgggataaaaagggagttttaaagaaatgtaagatgtgttgggattatttagtttttaatttatagatatttggatggagtttattttttttattaggagggattattagtggaaatttgtggtgtatgttggaataaatatcgaatataaattttgatcgaaattatttagaagcggtcgggcgcggtgttttacgttttgtaatttttttattttgggagattaaggcggggggaattatttgaggtcgggagttcgagattagtttggttaataggtgaaatttcgtttttattaaaaatataaaaagtagtcgggggtggtggtaggcgtttgtaattttagttattcgggaggttgaggtaggagaatcgtttgaattcgggaggttgaggttgtagtgaatagcgagatggagttattttattttagtttgggtgatagagtgagattttgtcgaaagaaagaaagagagaaagagagagagaaaaattatttagaagtaattatatattgtgtttatttttaattgagtagggtaaataaatatatgtttgttgtaggaatttaggaaataatgagttatatttatgtgattattttagaggtaatatgtagttattattttgggaatatttgttaatatttttgtttttttattatttttagtttatttgatatagtttatttgtgataagagtttttaattttttatttttgaatagaggtgttttttttttttttatttttgttttgtgagggagttaggggaggatttaaaagtaattaatatatgggtaatttagtatttttaaaattttgttaatagtttgaattcgggagtttggttttgtagttttataatattttagaagagattttatttgtttaaaaataaaaaggaaaaagaaaagtggatagttttgataatttttaatggagacgggagaagaatatgtagaaaaggggaaatgatgttggtttagaattttaattatattggtgtttaatataggaatatttatttatataatattttaaagtattaaatttatattagtatattattaaatggatatattattaaatgggtttaagtattttatatattttaatttaattgatttattttttttttgttttggatttttattatgatttaaatatttatatatgggttattttttagattttttatattatgaaatataagaaaaatttttaaggttagttttatgattaagacgaaggattttattgaatatataaaataataaatatattgtaatattttgtttttttttttgtagttgtaatttggtttgtttatattttttttttgtttttttgaaaattgagttagttttatttttttaggataggatttaataattataatataatttagtataattttttgatttaggtaaattatgtaatttgtgtttagtatgaaatgtatttaaaaataagtaatttttttttaatattattatttttaaattaatataataaataatagttattttaaaataaattgtttatttttattatgtagtatttaaattttaaggttgttatgattgtagatagtattttaaaatttttttttggaaatggttttgtttttaagatgatttaggaattaaagaggtgattattttttgtttaatgaatttttaaattataaatttgggaagtgt

SEQ ID NO: 212 - DNA, 4414 bp, Artificial Sequence
  chemically treated genomic DNA (Homo sapiens)
aatgtttggagtatatattttaatgaatatttattttattttatttttttttatttttgaattaagtaattttgaatttaaagttgttatgattagtattgaaaagattattggattattaattgtgtgattttgggatagtaattttttgtattttagtttgtttatatgttatatatgaaggttgaagtttgattttgttttgtgattattattttaaatatttgatgaaattaaattttagtgtttggaatggtagtataataaatttattaagaataaataatttattgtaaaaatatattgatttttaaatgatgtaattgatagttatattattgtagagggttgataaataataaaagaaatgaaagatgtatatggtgagaattgaaattattttgataagttttttatttgtttattatttaaaattaatgattatgttgaatgtttataaattataaaatataaaagaaattttataaatgcgtatgtataggagtttaagttattaaaagttttaaagtataagtttaaattaaattaattaaagaagttgagaggaaaaattggtttttatttttaattattattgttttgaggttttatgtttaatataattttttaagtagaggttttagagagaagagttgtgaggatatttttatatttgtgtagaaggaaaagtttgttatttattttagtatttttagtgttatattgatgtgtattttggatttattttgtttttattgtataaatttatatttgattttaaagaaaaggaaaatttaaagttttttttttttaaggggatagaaattttttgtgttaattgtttgatttttttttttgtaaggttttattggaaattttttgtaatataatgtaggggatttttttatgtgttgatgttgtttatatagtggggtgggtttgattgaagaaaaaaaatcgtatatacgtatgaaagattatggttttattttcggaaagtatgaaaggtgattgatatttttaagaagtttttgttatttaggaaaattattaaatattttatttagagatatttggaaagattgaaggaaaggaagaacgaagaaagtagaatttagatttatgtggggagagatttgtggtagaggaaaagtattttttttgaattcgataagggatttgtttgggggaattttttgtttagttttttattattagggttttttgaagtcgggttttttattgggtagttttttgggagtgtagtggggaatttttatattttttttttaggttttcgaaggatttcgtttttttagtgttttttttaggttggtaggagttttgagtttgatatttttttttgatgggataggtaagttttgtgggcgcgtaaatacgttgtaattaagttttttgttgattttatagttttgtgtgttttcgagaagaagtgatcgtatttaattgtttattgttggtttgttttttaagagtttgggggttttttttttttaatttagaattagttgtacggggggcggggaaatgggggtggggaaggagtgggagggtagtggttttcgcgagtagagcgatgttattgagtgagtttttgaatggggagcgttgttgtttttaagtcgattggtattttttgttaggaagaaacgttaagaggtgggagtgtttggggagggaggtaggcggtttttatcgtaggcgcggggagttgttttttcgttttttcgtttgttttttaagtttggatttttaggagtggttgaagttgcggagcgtttttggagtttgtgaatgaattttttttttttttttttttttttttttcgttgagtttttttttcggttttgacggtatagtgatataatgatgatgggtgttataattcgtatttgaatttgtaggcgagttgtttcgagtttttttggggaagaattttaggcgtgcggacgtaatagtcgagaatattaggtgttgtggataggagttgggattaagattttcggttagtttcgtattttttcgtattttttagtatcgtttcgtatttttcgtattttttttcgggttattacgttttttatgtgattcgtttgggtaacgtcgaatttagtcgcgtagcgttgtagtgaattttttttttaaattgtaataagtcgttttttaaggtaattacgttttttttgttttttttttaaaaaataaaaataaaaaatttatagaaaaaaattcgcgagtttagaaaaaagaagtaattggtagaaggttttaattaaggtaaagagttgtaaggcgaagttaagaaaatgtaggtatttaaaaaatgtaggtaatttttataagggtttttggggagaggtatatagagggattttggtgttgaaaaagatttagataaaagaaatttagggtggggtggggggtaaaatgattaacggaattgggggaagggagggaataaattgtaaagaaattatagaaaagtggtgggtttttgagttggagagaagagagggatttttggtattttgatttttttgttgttgttgtttttaatacgttcgaggtaaaagtttgaatggggattattaagatttgttatagataagttttcgaagtcgttttggtgtaggttatttggttttttagtttttggtgtgtggttagtgtttggtgtttttggaaagttattttcgggtagtttttgatagtgcgattcggcgtttaagtagtttgggattttgcgcggatttgatttttttagatcgtaggtagtttgggaggaggttcggtcgggggaggtgtaggattttcgtcgtgtttttttgacgatttggggattgttacggttttttttcggcgtttttgggtttttttgttttgtacgcggtgcgaaggggttagtagggaaggagtagaggatggggggtggggttgttggagtttcgcggaggtttgggaggtttttgggcgggaaaagtttgttttgaatcggtagggatgtgtaataattttttttattttgaagagtgaaatagggtttgtcgtttttattttaataagtaaatcggtatttagagcgtattgtagataaaggtggttcggggattcgaattaggggtttttgggttagttttttcgtttagattataggagtttttcgtttttttatatattttttatttttttttagtttttcgttttagttgagtaattttattggtaggtttagcggtagcggcgcgcgcgtgtgtcgggagtttcgggggacgttttcggttggagcgttttatcgttttgtagaggcgtgggcgttgtagggcgatatttttggtgcgtgtagatttagggtattcgggttgttttggttcgcggtttgtgttattgggcgtggagcggtttgggtgttaggtagaggagagcggggtagaaaaatagtgttatagtttaaattatttgttttttaatttaattgcgtttcggtaagttttgtatgtttttgggagatgttgcgggaagggggagaaatttatacggcgtttggagagttgttttgtcgcgcgtatattcgcggtagagtttttttgggtcgcgttttttatttttgtgtttttttttgtttttattttttttgttttttttttttttttttagtttttgttttttttttttagtttttgcgtttttttttttatagttgataaatgaatggttagtgtgaaatttttgtttttttcgtgttttaaggtagtagggagggaggagcgagggaggcggtgcgttttttcggatttgtttttagtttagtttataagatttgtagaatttagatgtttaggaattgggagttttgcggcgggtgtgggcgttttttgatggagaagtttcgtataggcggagaaaaataagttttttagattaagcgagtattttttataattttgtgtttaaggatggaaggttttagtttttttttaagttatttattttgtattttataatttgcggcgtatatttaggagtttggaggattttgaaaaaaggttttggtttgtgtaaagtgtagagatgttttttcgcgagtcggttggaacgtacgcggcgttttgggtttagttcgtcgtttagtggacgaacgtatatggttagggtggagttaggtttcggaggtttagacgcgttattttgggcgtttttaagaaagataatatatatatcgtgtttttaaaatttatgattatttgaatttaacgttagggtttcgttttaggatattgtaaaagaagggtttttaatttaaaatttaaatttttttaattttagggcgggcgtcggacgggaaagtggagagaaggcgggtagtgggaggaaaaaagaaagggaaggaaggga

SEQ ID NO: 213 - DNA, 4414 bp, Artificial Sequence
  chemically treated genomic DNA (Homo sapiens)
tttttttttttttttttttttttttttttattgttcgttttttttttattttttcgttcgacgttcgttttgaagttgaggaagtttaagttttggattaggagttttttttttgtaatattttggggcggggttttagcgttgggtttaagtggttatgggttttgagagtacggtatgtgtattattttttttaaagacgtttagggtggcgcgtttagattttcgaaatttggttttattttggttatgtgcgttcgtttattaagcggcgaattggatttagggcgtcgcgtgcgttttagtcgattcgcgagaaggtatttttgtattttgtatagattaagatttttttttagggttttttaaatttttagatgtacgtcgtagattgtggagtgtaaaatgaatgatttaagggaaaattagggttttttatttttgaatataaggttgtgaaagatgttcgtttggtttggggggtttgttttttttcgtttgtgcgggatttttttattagggggcgtttatattcgtcgtaaaatttttaatttttagatatttaggttttgtaagttttgtgagttgaattgggggtagattcgaaggagcgtatcgtttttttcgtttttttttttttgttgttttggagtacgggaaaggtagggattttatattagttatttatttgttagttgtgggggaggggacgtagaagttagagagagagaatagaggttgggagaggggaagggaggtagagaagatggagatagagggagatataaagatgaggaacgcgatttagagagattttgtcgcgggtgtgcgcgcggtaggataattttttaggcgtcgtgtagattttttttttttttcgtagtattttttagggatatgtaggatttgtcgagacgtagttggattggagagtaaatagtttaggttatgatattatttttttatttcgtttttttttgtttaatatttagatcgttttacgtttagtgatatagatcgcgggttagaataattcggatgttttaggtttgtacgtattagggatgtcgttttatagcgtttacgtttttgtaggacggtggggcgttttagtcgaggacgtttttcggggttttcggtatacgcgcgcgtcgttgtcgttagatttgttagtaaagttgtttaattagagcggagaattaggagagggtggggaatatgtaaggaaacggaggatttttgtagtttgggcgagaggattgatttagaggtttttgattcgggttttcgagttatttttgtttgtagtgcgttttgggtgtcggtttgtttgttgagatgggagcgatagattttattttattttttagggtgagaaaaattgttgtatatttttgtcgatttagaataggtttttttcgtttaggggttttttagattttcgcggggttttaataattttattttttattttttgttttttttttgttggttttttcgtatcgcgtgtaggataaaagaatttaggggcgtcgggagagaatcgtgatagtttttaagtcgttaaagagatacggcggggattttgtatttttttcggtcggatttttttttagattgtttgcggtttgaaggggttaggttcgcgtaaggttttaggttgtttgggcgtcgggtcgtattgttaggagttgttcgggagtggttttttaggaatattaggtattgattatatattaggggttgggaaattaggtggtttgtattaaggcggtttcggggatttgtttgtggtaagttttggtagtttttatttaaatttttgtttcgagcgtgttaagaataataataataaaaaaattaaagtgttaaaggttttttttttttttttagtttaagaatttattatttttttatgatttttttataatttattttttttttttttttaatttcgttagttattttattttttattttattttgggttttttttgtttgaattttttttaatattaaggtttttttgtatgtttttttttaaaagtttttatgaaagttatttgtattttttaagtgtttatatttttttaatttcgttttatagttttttgttttaattaaagttttttattaattgttttttttttttaagttcgcgggtttttttttataagttttttgtttttgttttttaaggggggaataaaagaaacgtgattattttggaaggcggtttattgtagtttggggggaaaatttattgtagcgttgcgcgattgggttcggcgttgtttaggcgggttatataggaagcgtggtggttcggggaaggatgcggagggtgcgggacggtgttggaagatgcgggaggatgcggggttggtcgaagattttggttttagtttttgtttataatatttaatgttttcggttgttgcgttcgtacgtttggagtttttttttagaaaggttcggggtagttcgtttgtaagtttaaatgcgggttgtgatatttattattattatattattgtatcgttagagtcgaggaggagatttagcgagaagaaggaggagggagaggaggagggtttatttataggttttaaaagcgtttcgtagttttagttatttttaagagtttaggtttggaaagtaggcggaggggcggaaaggtagtttttcgcgtttgcggtagggatcgtttgtttttttttttaggtatttttattttttggcgtttttttttgataagaagtattaatcggtttggggatagtagcgttttttatttagggatttatttagtaatatcgttttgttcgcggaaattattgtttttttattttttttttatttttattttttcgtttttcgtgtagttagttttgggttaggggaaaggagtttttaggtttttagggggtaggttagtaatagataattgagtacgattattttttttcgggagtatataaaattgtaaaattagtaaagaatttggttatagcgtgtttacgcgtttatagagtttgtttgttttattaaagggaagtgttaggtttaaggtttttgttaatttgaaagagatattgagaaaacgagatttttcggggatttagagggaaagtgtaagaattttttattgtatttttagggaattgtttaatggggagttcggttttaaaagattttggtaataaaaggttggataggaaatttttttaggtaaattttttgtcggatttaaagagaatattttttttttgttataaatttttttttatataagtttagattttgtttttttcgtttttttttttttttagtttttttaagtatttttgagtagaatatttgataatttttttgagtaatagggattttttggaagtattaattattttttatgtttttcggaaataagattataattttttatgcgtatatgcgattttttttttttagttaggtttattttattgtgtaaatagtattaatatatggaagagttttttgtattgtgttataaaagatttttaataggattttatagagaaaagggttaaatagttgatataaaggatttttgtttttttagaaaagagggattttggattttttttttttttgaagttaagtatgagtttatataataggaataaaataaatttaaggtgtatattagtataatattagggatattagaatggatggtaaatttttttttttatataaatatgaaagtatttttataatttttttttttgaagtttttatttagaaaattatattaaatataggattttaaaatagtagtgattaaagatgaaagttaatttttttttttaatttttttgattagtttggtttaaatttatgttttaaaatttttagtaatttagatttttgtatatgcgtatttataagattttttttatattttgtaatttgtaggtatttagtatggttattgattttaagtgataaataggtagaagatttgttaggataattttagtttttattatgtgtattttttattttttttgttatttattagttttttgtagtaatataattgttagttatattatttggaaattaatgtgtttttgtagtgaattatttatttttagtaaatttattgtattattattttaaatattgaaatttgattttattagatgtttagaatgatagttatagagtagaattagattttaatttttatgtataatatgtaaataaattaaggtgtagaaagttattgttttaaagttatataattaatagtttagtggtttttttagtgttaattatagtaattttagatttaagattgtttgatttaggaatggagagaaataaaataaaatgaatgtttattgaaatatatattttagatatt

SEQ ID NO: 214 - DNA, 4001 bp, Artificial Sequence
  chemically treated genomic DNA (Homo sapiens)
ttgatatggaatagagttaagatttttttttttttttttgatacggagttttattttgttttttaggttggagtgtagaggcgtaattttagtttattgtaagttttgttttttaggtttacgttatttttttgttttagttttttgagtagttgggattataggtattcgttattatatttggttaattttttgtatttttagtagagatagggttttatcgtgttagttaggatggtttcgattttttgatttcgtgatttgtttgtttcggttttttaaagtgttggaattataggtgtgagttatcgcgattggttagatttaagatttgaatttaggtttttttggttttagaggtttttgttttttaattttttaggatggtatagtaatttgttttataagaggtgtttgttttaagtgtgtttagtatatggaagtaagtttagaaatgtaagtgtatatttgtaaagaggtgtgggagatgggggggagggaagagagaaagagatgttggtgttttttattttttagtttttgataggtgtttttgatttttttttgattagtatagttgtatttttggttggggtattttaattagaattgttaaatttagtatataaaaataaggaggtttagttaaatttgaattttagataaataatgaataatttgttagtataaatatgttttatgtaatattttgttgaaattaaaaaaaaaaaaaaaagttttttttttatttttatttttattattaggtttaaggaatagggttaggggttttaaatagaatgtggttgagaagtggaattaagtaggttaatagaaggtaaggggtaaagaagaaattttgaatgtattgggtgttgggtgtttttttaaataagtaagaagggtgtattttgaagaattgagatagaagtttttttgggttgggtgtagttgttcgtggttgtaattttagtattttgggaggttgaggcgggaggattatttgaggttgggagtttaagattagttttattaacgtggagaaattttgtttttattaaaaatataaaaaattagttggttatggtggtatatgtttgtaattttagttgttcgggaggttgaggtaggagaattatttgaattagggaggtagaggttgtggtgagtagagatcgcgttattgttttttagtttgggtaataagagtaaaagttcgtttaaaaaaaaaaaaaagttttttcgatgtgattgtttttttttaaatttgtagatttttttaagattatgttttttagatattttaaagattttagaagatatgtttcgggggttttggaagttataaggtaaatataatatatttttttttttgattattaattttattagaggatgtggtgggaaaattattatttgatattaaaataaataggtttgggatggagtaggatgtaagttttttaggaaagtttaagataaaatttgagatttaaaagggtgttaagagtggtagtttagggaatttatttcggatttcgggggagggggtagagttattagtttttgtatttagggatttttcgaggaaaagtgtgagaacggttgtaggtaatttaggcgtttcggcgttaggagggacgtatttaggtttgcgcgaagagagggagaaagtgaagttgggagttgttatttttagatttgttggaatgtagttggagggggcgagttgggagcgcgtttgtttttaattataggagaaggaggaggtggaggaggagggttgtttgaggaagtataagaatgaagttgtgaagttgagatttttttttattgggatcggagaaattaggggagtttttcgggtagtcgcgcgtttttttttacggggttttttattgcgtcgcgcgttcggtttttatttttcgtagtatttcgcgtttcgcgtttttttagtcgggtttagtcggagttatggggtcggagtcgtagtgagtattatggagttggcggttttgtgtcgttgggggttttttttcgtttttttgtttttcggagtcgcgagtatttaaggtgggtttggtgtggggaggggacggagtagcggcgggattttgttttgtggatgtttcgtcgaggtttcgcggtcggcggggttagaggggttcggacgagtttttttatttcgaagttgtggatagtcgagacgtttagggtagtcgggttttggggttttcgggcgggagggggtagttatacggtagcggttcgagatggtttatttaagagattggcgttttttaggtttcgaggggtttcgggaatttgttaaagaagttttttgaaattgtttagaaagttttttcgtaaagggtgtattgcgtagagcgcgcgcgcgcgttttttttttttttgagtttttttaagtttttttaaagtttttttagttggtagttttcgttttcggattggtttgggttggattttttgggggggttttttgttttgttttttttttagttttttttcgtttttttttagacgattttggtttggttgtttttgtttttggcggggtcgggtgtgtgtgtgtgtggtggagtggagggtggtatagtaatttgttttaattagagtcggggaggaaagggtggttcggagggtggttttttgttggggtttgggttgggggcgggggagacgtttgttttgaatagatttttggggttagtttagggattgtgttttgtgatttttggagcgcgtggattatggaggggtgggggtgggttttttggggtgtaaagtgggagagtttttagagaaggaagttaagaaataaggttagatgggagtttagggagggttgcgttgttttgttgttttttttttggtgttgtgcgtggggaagggtgagtgggggtagtgtgtattttgatttatttgtttatttgtgtgtattaattataaaagttaatatatagtttgggttaggtatattttgttaggaattgtttgtggtgttttgtatgtatttttttttaattttagaatatttttatagtggaagttttgttagtattttggattgagtagtagtttagaggttgagtagtagttagtaagtggtggggttaagatgggattttaggtagtgcgatttttaattatgtattcgaaatcgttatatggatgagtgtatttggagtaatgagggatattgttttttgagttattgggttgtaggggagataaaatgaaagtgttttgggagtcgtgggtggtttttataggttagagggtttggggagggagtgggtgttatcgtggttgtgtgttgttcgaggggttttttgtgagtgagtgtatggtcgtgttatttttgtaggtttacgttagggtgttttttagttgtgtggtttttgtatttgtgtgtttgggttttgtgttgttaaatagtagtttttttgttgatttggggatataggttgaattttgttttttgtaggaatttttttaaggtgttgggttagatttgttataaatagagggaggtagttttttatggttacgtttttttgttgaggaagaaggttttttttttttagggagtatatttttgttttttttgttttttagataagtatttttattttttattttttgatgagaagggtgaggttatattgagttgttaggttgagttgttgtttttttttattttgggttgggagttgattagggaatggtagttgttgtagagttggatttgagggttgggttttttggatggggtttttttatgtttttattttttaatttgtattattgattgtgttgtgtaggagttagttaaaaagttattgtatagtttgggtaataaggtaaaattttgtataaaaaatataaaaattagttggatgtgattatacgtgtttgtagttttagttatttcggaggttgaggtaggaggattatttgagtttaggaagttgaggttt

SEQ ID NO: 215 - DNA, 4001 bp, Artificial Sequence
  chemically treated genomic DNA (Homo sapiens)
aagttttaattttttgggtttaggtgatttttttgttttagttttcggagtagttgggattataggtacgtgtaattatatttaattaatttttgtattttttgtatagagttttgttttgttgtttaggttgtgtaatgattttttaattaatttttgtataatataattaatagtgtaggttgaggggtgaggatatgaggaggttttatttagagaatttagtttttaaatttagttttgtagtaattgttattttttgattaatttttagtttaaggtgaggaagggtagtagtttagtttgatagtttagtatggttttattttttttattagaagatgagaggtgaagatgtttgtttgggaaatagggagggtaaggatgtattttttggaagagaggaatttttttttttagtaagaaggcgtggttatagaaggttatttttttttgtttatggtagatttggtttagtattttaagggagtttttgtagaggatagagtttagtttgtgtttttaagttagtagagagattgttgtttggtaatataaagtttagatatataaatataaagattatataattgaggaatattttggcgtagatttgtagagataatacggttatgtatttatttatagagggtttttcgggtaatatatagttacgatgatatttattttttttttagattttttgatttatggagattatttacgatttttagaatatttttattttgttttttttgtagtttagtgatttagggagtagtgttttttattgttttaggtgtatttatttatatagcgatttcgaatgtatggttgggggtcgtattgtttggggttttattttgattttattatttattagttgttatttaatttttggattgttatttagtttagaatgttggtagaatttttattataggggtgttttaggattaaaggagaatgtatgtaaaatattataaatagtttttggtagagtatatttggtttaggttatatgttagtttttatgattaatgtatataggtggatagatgggttaggatatatattgtttttatttatttttttttacgtatagtattaaggaaaaggtagtagaataacgtagttttttttaggtttttatttggttttattttttagtttttttttttgggaatttttttattttatattttaagaaatttatttttatttttttatggtttacgcgttttaaaagttatagagtatagtttttaagttggttttaagaatttgtttaaagtaaacgtttttttcgtttttaatttagattttagtaagaggttatttttcgggttattttttttttttcggttttggttgggataggttgttatgttattttttattttattatatatatatatattcgatttcgttagaagtaggagtaattaaattaaaatcgtttgaaggggagcggggaggggttggaggaggggtagggtagaggatttttttaaggaatttagtttaggttagttcggaggcggaggttgttaattggaaaggttttgagaaagtttgagggggtttaagaaggggggaaacgcgcgcgcgcgttttacgtaatatattttttgcgggaaaattttttgaataattttagagaatttttttgataagttttcggagtttttcggagtttggaaagcgttagttttttggatgggttatttcgagtcgttgtcgtgtaattgttttttttcgttcgagggttttagggttcggttgttttgagcgtttcgattgtttataatttcgggataggagagttcgttcgggtttttttggtttcgtcggtcgcgggatttcggcggggtatttatagggtagggtttcgtcgttgtttcgttttttttttatattagatttattttgggtgttcgcggtttcggggggtaagagggcgaggaggagtttttagcggtataaggtcgttagttttatggtgtttattgcggtttcggttttatggtttcggttggattcggttgggagggcgcggggcgcggggtgttgcgaggggtgggggtcgggcgcgcggcgtagtaaagggtttcgtgggaaggggcgcgcggttgttcggggggtttttttggttttttcggttttaatggaggggaattttagttttataattttatttttatatttttttaagtagttttttttttttatttttttttttttttgtgattgggagtaagcgcgtttttagttcgttttttttaattgtattttaataagtttgggagtggtaatttttagttttatttttttttttttttcgcgtaggtttgggtgcgttttttttagcgtcgggacgtttgggttgtttgtagtcgtttttatattttttttcggagaatttttaaatgtagaggttggtgattttgttttttttttcggagttcgggataaattttttaggttgttatttttaatatttttttaagttttaggttttattttaaatttttttggggagtttgtattttattttattttaagtttatttgttttaatattaaataatggtttttttattatattttttagtaaaattgatagttaaggagggggatgtgttgtgtttattttgtggtttttaggattttcggggtatattttttggaatttttgaagtatttgaaaagtatgattttaagagggtttataaatttgggaggagatagttatatcgaaaggatttttttttttttttaaacgaatttttgtttttgttgtttaggttggagagtaatggcgcgatttttgtttattataatttttgtttttttggtttaagtgatttttttgttttagtttttcgagtagttgggattataggtatgtgttattatgattagttaattttttgtatttttagtaaagatagggtttttttacgttggtgaggttggttttgaatttttaattttaggtgattttttcgttttagttttttaaagtgttggaattataattacgagtaattgtatttagtttaaaaagatttttattttaattttttaaaatgtattttttttgtttatttaaggaggtatttagtatttaatgtatttaaggttttttttttgttttttgttttttattagtttgtttaattttattttttaattatattttatttggagtttttgattttattttttaggtttagtggtaggggtggggatggaaggaagatttttttttttttttttaattttaataagatattgtatgggatatatttatattaataaattatttattgtttatttgaaatttaaatttaattgggtttttttatttttatgtgttaaatttggtagttttagttggaatgttttagttaagaatgtagttatattggttaagaagggattaaaggtatttattagggattggagaatgaaggatattagtatttttttttttttttttttttttttattttttatatttttttataggtatatatttgtatttttaaatttgtttttatgtgttgagtatatttaaagtaggtattttttgtgggataggttgttatgttattttagggagttgagaaataggggtttttgggattaagaggatttgggtttaaattttgaatttggttagtcgcggtggtttatatttgtaattttagtattttgggaggtcgaggtaggtagattacgaggttaggagatcgagattattttggttaatacggtgaaattttgtttttgttaaaaatataaaaaattagttaggtgtggtggcgggtgtttgtagttttagttatttaggaggttgaggtaggagaatggcgtgaatttgggaggtagagtttgtagtgagttgagattgcgtttttgtattttagtttgggagatagagtgagatttcgtgttaaaaaaaaaaaaaaaaattttgattttattttatattag

SEQ ID NO: 216 - DNA, 4334 bp, Artificial Sequence
  chemically treated genomic DNA (Homo sapiens)
aaattaattacgaaaaaaattattaaaatttattaaataaatattgggaaatatgatttgaatatgatattggttttagaaaattaagttaattgagttttttcggttataaaatttttggatttttaaaattagataaagttataagggtgaagaattttttttttataaattttttaatattttatcgaaattgtaagaagatattttagatttaatttaatagtgttttcggagttattttaatattgtttataatttattgtgtaaatgaaatatttatttttgttttgtttgtgtttgacgtggtggataagaaaacgtttaagttaatagtaattaataatgttgaatttttattgttttttaggtttaagtttttttgtttaatagtaagtaaaatgtttatgaatttttagattttgatttatatttgttgtcgttatgttatgaaaaatgttgtattttttgttgatttttttaatattatgatttttgtagacgttagttagtattaaaaacgtaggatgataggtttttaaaagttaggaattaaaattagaggtagcgataagatttaagaaaagtagagaattagacgtagtatcggatttaggatgggcgtggttttggttcgggcgaggaaaagaggatcggtcgttttcggttaattagagtacgttttgcgtttcggtttttggtttcgtttttttttttttcgcgttttttcgaattttttcgaatttaatatttcggagttcgcgcgcgtgggaaggggaggggtgggcggggttaacggtttaattcgggtaatttcgtttttgtttgattttttttgcgcggacgttttttttaattttcgttaaaaatatttttaggtcgtcgttattattttttttatagtttagcgggtggggtaggtttcgggaataggttttcgggtggtttcgcggtgagttcgttatcgtttttcgtcgtttttatgtttaatttgtcgttatttacgttgttcgcgcgttcggtcgcgaagatagaagaattttcgtggggttcgggagcgtcgttttttaattattagttgcggtcgttaggggacggtcgtagggagggtcgcggttttggttgttcgtagtttggttttaaagtcgttggtttttggggtatcgtttcgtttttttagataatggggaattcggcggggttcgtagggaagggagggagggagggaggtaaacgagggtttacgttttttattgttttttcgacggtatttcggagcggacgttcggtgatcgtttagttttttgtttacgaatagtcgcgttttcggagagcggggataaaggcgaggtttcgttcgagttatatataaagcggagcgattttcgtttattaattttttcgaggttcgtagtttcgttcgtcgttttgtagtagggggtcgttgttacggtttagtttttttcgtcgatcgcgttttttttgttggttttagttagtcgtcgtttttttcgagtttcgtatttatttgtttagttcgagtcgtttgattatattttgagtattaatagattcgggcgcgtataaaagcgttaaatagaggtacgtgattttcgcgcggggtttcgtattggtcgagagcggcggtacgtgtcgttttcgttttttataattcgcgtggagcgtcgtttttcgggatttcgaagtatttcgggaagtgtagttttgtttcggagggtaggaggataatgtcgggggttgtagggcgtttggggagtatttttaggtgtgggtttgggattaggggggtggtttcgtcgtggaagagggcgtggtagtggatttcggattaggttcgaattagttttttattttcgagaataagggtagggcggagtaggcggagggcgggggggtttttttttatttttttaaattttggtcgtttggattttattttgtagagttatatgttcgtttcgttttaagggtagtattcggatagagtagtgttttttttagtgcgttatttatatgggtgtttaagacgttcgagtttttgtgatagtataatgttattttacgtttttgtagggttttttgttttcggtattttatatcgatatcggcgtgttatttatattgtgatattatcgtaatttttaatttatttagtttataggtcgcgggcgtggttttttttttattgtgtgcgtttttgttagtatttttaggttttcgagtcggtgattagggatttgtgcgggaaagcgtggggttttggaatttgatcgtttttggtttaataaagttatttagtttaaatgtagattttatttgtttttttaagttttttgcggatgataggggaggaagagtaatagtcgttttagattatatagattgtagttaagtgttgtttttgtttttagagtacgtgttttttagagtagtattgggttttttttaaaaatcgaaaaaggagttataaggttattgttttttttgatttggatagtttagaattttagtaaaggtataaaggaaattggtttgatcgtgttttagaataattggtttttttttttataaaaaggggaaaaaaataaatgaaatgaatatggttttcgtttttttttattttttgattaagatcgtgttttcggttggtggttaatatattaagatatttgttttgagattttgattaagtagaagagatatttttattttattaatgagttgtatttttttaaattaagaaataaatgtgattaatttttttgaaataatagttttaatttagaaagatttttatgtttagttagttattagggatgtgttagagataaaatataattaaggggtgtttaagataataaaaattggattatataagtagtagtatattatataaagtaaataattagtaatgcgttgttgtttgaaatatgtttgttgcggtattttttttaataatcgtttttgtgtggggtcggttttttttttaagttaatcgaagtggtttttatttagtttgtgagtaggattaggaataatttagatattgagttttgaaaggtttttttttagattaaatttagttttaaaatggttaggtgttttcgtttgttatttttttgaatagaattttagatattattagaaaagttggagaaggatgggtatgagattttttaggaaagcgatagataggtaggtaatataaatgagtaaggaatttaagtttaagaggtttttatttattgaataggttttttattttgaagtttttgtatttgatttggaggtttatagaggaaggttttatttatttaatgtatttttttaagtataataaattgttatataaaagttttatatttttgattattaatgttgtgatagaaaaaagaaataaattttttaaaatattgataatttgaaagtatttatattgtttttttttatattttttttttttttagagtagatgtttatttttatggaaattatagtaaggaacgtagatgttagaatttatgtttatttttaattttttttagtaatgttatttggtttttgggtttgttgggagatgtttggttttgttagtttgtgataatgttttaagttttttatagttgtttgaggattgagagggttgggttaaagttttttttagaatgagtttttgaataaaaaggtgtttttgaggtgggatttttgtttttttattattattattattattattattattattattattattattattatttgatttaaaaaaaattgagatagggttttattatgttgtttaggttggtttcgaatttttgggtttaagtaatttttttgttttagttttttaaagtgttgggattataggtatgagttattatatttagtttgatttttgttttttagggtggggttgtttttttaagagttagattatagtttattattgttagtttttgtgggtgttttatataagttttggaataggaagggtttttaattgtaaggagagataatagttttgttattttattttggagaggggtagaatcgtttttttcgaaagttttttaaaacgaattttaagatttatttttttttgaagtggtagtaaggagttaatgtttatattttggaattgtttatttttgtttataagaattatttttgtttttgtttagatggtttggttggattgttatggagttggttgtgattatggagttatataacgaagtggagatagggtagttatttagtttatttgatttgtgtagatagttaaaggagagtattttaggttttaa

SEQ ID NO: 217 - DNA, 4334 bp, Artificial Sequence
  chemically treated genomic DNA (Homo sapiens)
ttgaagtttgaagtgtttttttttagttgtttatatagattaaataagttggatgattgttttatttttatttcgttgtgtggttttatagttatagttagttttataataatttaattaaattatttgagtagaagtaaaaataatttttatgggtaaagatagatagttttaagatgtgaatattaattttttgttgttattttagaagagagtggattttgaagttcgttttaggaagttttcgagaagggcgattttgtttttttttaaggtgaagtggtaaaattgttgtttttttttatagttgaaagttttttttattttaaggtttatataggatatttataaaagttgataataatgagttgtgatttggtttttgggaaggtagttttattttaaagaataaggattagattgggtgtggtggtttatgtttgtaattttagtattttgggaggttgagataagaggattgtttgaatttaggagttcgaggttaatttgggtaatatagtgagattttgttttaattttttttaagttaaataataataataataataataataataataataataataataataataaaaggataggaattttattttaaaagtatttttttatttaaaggtttattttaggggaaattttaatttagtttttttagtttttaagtagttgtgaggagtttggaatattgttatagattggtagaattaggtattttttaataaatttagaagttaagtggtattgttaaaaaagattaaaaatgaatatgagttttaatatttacgttttttgttatggtttttatggaaatagatatttgttttagggagaaagaaaatgtggggggaagtagtgtaagtgtttttaaattattagtgttttgaaagatttattttttttttttgttataatattaatagttaggaatgtgagatttttgtgtggtaatttattgtatttaaaaaaatgtattaaatgagtgggatttttttttgtgaatttttagattaaatataaagattttaagataaaaagtttgtttagtgggtaaggattttttgggtttgggttttttgtttatttgtgttgtttgtttatttgtcgtttttttgaggggttttatgtttatttttttttaatttttttaatgatgtttgagattttgtttagaaaaatgatagacggaagtatttagttattttgaagttaagtttggtttgagaagaagttttttaaggtttagtatttgaattatttttggttttgtttataggttaagtgaaaattatttcgattggtttgggggggaggtcgattttatataagggcgattgttggaaaaaatgtcgtaataagtatattttaggtaatagcgtattgttaattgtttgttttgtgtagtgtgttgttgtttgtatgatttagtttttattgttttgggtattttttagttgtattttatttttggtatatttttggtgattaattaggtatgagagtttttttaaattaggattgttgttttaggaaggttggttatatttgttttttgatttggggagatgtagtttattaataaaataaagatattttttttgtttagttaagattttaaagtaggtgttttggtgtattgattattaatcgaggatacggttttggttagagaatgggaggaggcggggattatgtttattttatttattttttttttttttttgtgagagaaagggttagttattttaaggtacggttagattaattttttttgtgtttttgttgaggttttgagttatttaggttagggagaatagtgattttgtggtttttttttcgatttttaaaaagaatttagtgttgttttggggagtacgtgttttgagaataaaagtaatatttaattgtaatttgtgtagtttagaacggttattgtttttttttttttattattcgtagaaggtttggaagaatagatggagtttgtatttaagttgagtggttttgttagattaaaggcgattaaattttagagttttacgttttttcgtataggtttttggttatcggttcgggaatttgaggatgttggtaagaacgtatatagtgagggaagggttacgttcgcgatttgtgggttgagtggattagaaattacgatgatgttataatatgggtgatacgtcggtgtcggtgtagggtgtcgggggtagggggttttgtaggggcgtggagtggtattgtgttgttataggggttcgggcgttttaggtatttatgtgggtggcgtattagaaggggtattgttttgttcgagtgttgtttttggggcgaggcgggtatgtggttttataaggtggagtttaggcggttaaagtttggaaaggtagggaaggattttttcgtttttcgtttgtttcgttttgtttttgttttcgagaatggggagttggttcggatttagttcggggtttattgttacgtttttttttacggcgagattatttttttagttttaggtttatatttggggatgttttttaggcgttttgtaattttcggtattgtttttttgtttttcgggataggattatatttttcgaggtgtttcggggtttcggggggcggcgttttacgcgggttgtggggggcgggggcggtacgtgtcgtcgttttcggttaatgcggagtttcgcgcggaggttacgtgtttttgtttggcgtttttgtgcgcgttcgggtttgttggtgtttagagtgtggttaggcggttcggattgagtaggtgggtgcggggttcggaggaggcggcggttggttgaggttagtaagagggacgcggtcggcgggaggggttgggtcgtggtagcgattttttgttgtagggcggcgggcggggttgcgggtttcggaggggttggtgggcgggggtcgtttcgttttgtgtgtggttcgggcggagtttcgtttttgttttcgtttttcgggggcgcggttgttcgtgggtagggggttgggcgattatcgggcgttcgtttcggggtgtcgtcgaggagataatagggggcgtgggttttcgtttattttttttttttttttttttttttgcgggtttcgtcgggttttttattgtttgaagggacggggcggtgttttagggattagcggttttaggattaaattgcgggtagttagggtcgcgattttttttgcgatcgttttttggcgatcgtagttggtgattgaggggcggcgttttcgggttttacgagggtttttttgttttcgcggtcggacgcgcggatagcgtgggtggcggtaggttgggtatggggacggcgggaggcggtggcgagtttatcgcgggattattcgggggtttgttttcggggtttgttttattcgttgaattgtgaagggggtggtggcggcggtttggaggtgtttttggcgggagttggggggggcgttcgcgtagggggagttaggtaggggcggagttattcggattggatcgttagtttcgtttattttttttttttttacgcgcgcgggtttcggggtgttgagttcggggagattcgaaaaggcgcggggaggaagggggcggggttaggggtcggagcgtaaggcgtgttttgattggtcgggggcgatcggttttttttttttcgttcggattagggttacgtttattttgggttcggtgttgcgtttaattttttgttttttttaaattttgtcgttgtttttgattttaatttttagtttttgggaatttgttattttacgtttttggtattagttggcgtttataaaagttataatgttaaaaagattaataagagatatagtattttttatgatataacggtagtaaatataagttaaaatttagaggtttataaatattttgtttgttgttgggtaaggaagtttaaatttgagggataataggagtttaatattattggttattattagtttgggcgtttttttatttattacgttagatatagataaagtaggggtgggtattttatttgtataatgagttgtaggtagtattaagatggtttcgggggtattgttgagttgaatttggaatatttttttatagtttcggtgaaatgttaaagagtttatgggggaaaaattttttatttttgtgattttgtttgattttaaaaatttaagagttttatgatcgagaaagtttagttaatttgattttttggaattaatattatatttaggttatattttttaatgtttatttagtagattttgataatttttttcgtggttaattt

SEQ ID NO: 218 - DNA, 4528 bp, Artificial Sequence
  chemically treated genomic DNA (Homo sapiens)
cgcgtagatttgttaggaagagtataagaagaaatattcggatttttttgttaatttcgtggaattttttaagaagtgtttggagagatggaagattacgtttgtaaaggagaagtgaagtttgaagagaaggtaaaaagtgataaagttcgttgtgatagggagattaaaaattatattttttcgaaatgtaagaaagggtaagaaaggaaagaaaaaggatcgtaatgtttttagaaggttattatttgttttttttttgttttgttttgaatatcgtttaaagattaaaagtggatatttaggtttatttgtcgtggaaattgtaaagaaattgggtgaaatgtggtttgggtagttagttaaagataaataattatatgagtagaaagtagttaagttataggagagatatgaaaagggtattgttgtatatcgtgttaagggtaaaagtgaagtaggaaagaagggtttaaagaagaataaattagaagatgaggaggaggaggaggagaaagaagatgaagatgaggaggaagagggtgaagatgaagaataaatggttattttttaatgatgtttgtgtagtgggtttgttttgttaagaatgtgaattttagtatagtttagtattagttttagtataaaattgtataaattttcgtatagtttataagattttttgtatagaaaatattttttttttttttttttttttttgagatagagtttcgtttttgttgtttaggttggagtgtaatggcgtgatttcggtttatcgtaattttcgtttttcgggttttggtttaagtagtttttttgttttagttttttgagtagttgggattataggtatatgttattacgtttagttaatttttgtatttttagtagagatggggttttattatgttggttaggttgtttttaaatttttgatttcgtgattcgtttgtttcggttttttaaaatattgggattataggtgtgagttatcgtattttgtttaatgtttttaaatatttaatggtttttaaaaaatttattgtgtatggtagtatagtatatttgtaggaattagtattaatagtatattttgcgttttttaagatgttgtattttttaatattttgtaataaaattatgcgtattaaaaaaataaagaaatttcgtgtgtagtttatatttatagtatattttcgtttaggtatttgagagaatgattaggaggggtttttggaggaggtggtttttgaacggagaatttatttttaaggattttgtttgtaatggttattaagtattttttgagttatttttatgtgttttgtagttttttgaaggggcgtgggatttatcgatgttaattatttagtattatttttagattttaagaagttggggtgtgagttagtaattagtatagaaaagagatattaaaataagtttgagttggggagtgtttttttaattttagttttttggaagagattttttttttttttttgagatagagtttcgtttttattgtttaagttggagtgtagtggtacgatttcggtttatcgtaatttttttttttcgggtttaagcgattttttttttttagttttttgagtagttgggattatagatatgtatttgtaatttttattaaaaatataaaaattagtcgggcgtggtggcgtacgtttgtaattttagttattggggaggttgaggtaggagaatcgtttgaaattaggaggcggagattgtattaagatagtttgttttagttaaataatttggcgttagtgtaggaaaaggtggaaggtacggggttagtataggagggtttaatatttttaattttattaagttatattttggtaatttttgttttttacgagaagttttcgttgggtttgttttagcgttgttttgaggttttttttatgagtttcgatagggtagaggtcgttttgagcgttttttttttttttggtttaagagtggtttaaaagaaggatttttgattggaattggttattttgtgttattttttgatttttgatttcgttttaaagggggatgcgggggaggggttttggtaggggtggtttcgttttttttaggttcgtaagtttaggttttcgtttatcgggtttagtttattttgcggtcgtttagggaggtcgttggtattcgtgatttacgatttttttttcgagttttatcgaggttatagtcgtggtttcgtttttttatgtttgtttttcgttttttgttcgtgacgggcgttttcgaggattaatgagcgcgttgtatttatttttcgggcggggttaagcgtcgattaatcgtcgttcgggcgttcggtcgggtttaaacgttttaatcgttagcggcggcggggcgggtagagggtcggggatggtaggtttaattaacgggtgggtacgtcgttttcgcgaggaggcgtgttttgcggtcgggcgtgcggtgttcgcggcggcgtagggagggggagggaggtaaataagatggcggcggcgtgtcgggcgcggaagggggaggcggttcggggcgttcgcgagtgaggcgcggggcggcgaagggagcgcgggtggcggtatttgttgtcgcggttttggatgggttgggtttttttcgtcgtttcgttttttttatacgcgcggcggtcgcggcgagggggacgcgtcgttcggggttcggtattttcgggaatttttcggttcggagtttgcggtttgcgtcgtttcggtcgtcgggagtttcgtggagttttcgtcgtcgcgtcgtttcgcggatcggacgttgagggtattcggggcggggcgcgcgttcgggtagacgtttgcggggaggggggcgtttgtcgggtttcggcgattattttgggggtcgcgggtcggttcggggggcgtttagtgcgggttttcgcgggcgtcgggtagcgattagttttgagcggagttgttggtcgcggcgggaggtttttcggacgtttttagtttttcgaacgttcgttcgggtcggcgggagtcggcgtttttcgggaggttcgttcggtcgttcgcggcggagcgtttgtttttgggataggcggtgggatcggggcgtcgtcggagacgtttttagcgaagttgggttttttaggtgtgggggtttcggggggtagcgacgtcgcggattcggtttgtgggatgggcggttcggagaagattgcgttcggtcgtgtttatatttgttcgtgggtttgaggttttcggaggatgatttagtattgaaaagtttcggtcggtttttttagggttttcgaggacgaagttgattttgatcgggtcgttttttagttttgaggttcgggttttattggaattcgcgtttgagtcgtcgtttcggattttcggtgttcgtcggttcgtagattttgtatcgggtttggattcgtagtcgggattgacgtgtagaataatcgtttttgttggaagaagggttttttttttttttttggggtttttgttgtttttttttttttttttttttttgtaaaattttggagaagggaagtcggaatataaggaaggatcgtttattcgcggatttagggttggcggcgggattttaggattttgggtttagtatggaggtggtggattcgtagtagttgggtatgtttacggagggcgagttgatgtcggtgggtatggatacgtttatttatcgtatcgattttatcgaggttatttattagtcgcgtcgtaagcgggttaagtttatcggtaagtatttgatgggggatttgttgggggaaggtttttacggtaaggtgaaggaggtgttggattcggagacgttgtgtaggagggtcgttaagatttttaagaagaagaagttgcgaaggatttttaacggggaggttaacgtgaagaagtaagtatggtttgttggggtcggggtcgggtcgggttagttacggtgttgatggttttgttttttttttttttttttttttttttttttttatttttttttaatattttgagttggattcgtttggcgtttgtgtttttcgtgttagggagagcgtggttgggggtttgcgttacggatttttatttaggtaaggttagttgtcgtagcggggcgtgcgtttgtatgggtttttggattttagttaaaatgttttggtagcgaaatttttttgagaagggagcggtttttaattttttaagattagttttttggtttttttagttgtttaaggagtagaggcgtttagtggaattagtttgtgtttgtttgggtttcgagagtttgtgtgcggtcgttaatacgttttttgcgtagtgtgtggtcgttatcggggttaggcgaaatgtgatttgtttattttgttagaggggaattttgggttgttaaaaataattgtttgtatcggtttattagttagtaggagggaaacgtagtttttttttatttgttagggatgtgacgttggaagtatttttggttttcgggg

SEQ ID NO: 219 - DNA, 4528 bp, Artificial Sequence
  chemically treated genomic DNA (Homo sapiens)
tttcgggggttagggatgtttttagcgttatatttttggtaaatgaggaaaggttacgttttttttttgttgattgataagtcggtgtaaatagttatttttggtagtttagggtttttttttgataggataaataaattatatttcgtttggtttcggtaacggttatatattgcgtagaaaacgtgttggcggtcgtatataaattttcggggtttaaataaatataggttgattttattgggcgtttttgttttttggatagttgggggagttaaggggttagttttaggggattgggggtcgttttttttttaggagggtttcgttattagggtattttaattggagtttaagagtttatgtaaacgtacgtttcgttgcgataattggttttgtttgagtgaaagttcgtaacgtaggtttttaattacgttttttttggtacggaggatataggcgttagacgggtttagtttagggtgttaagaggaagtaagggagggagggaggagagaaggaaggaagatagaattattagtatcgtgattggttcggttcggtttcgattttagtaagttatatttatttttttacgttggttttttcgttggggatttttcgtaattttttttttttgaggattttgacggtttttttgtatagcgttttcgagtttagtattttttttattttgtcgtaagagtttttttttagtaggttttttattaggtatttgtcgatgagtttggttcgtttgcggcgcggttggtagatgatttcggtggagtcgatgcggtggatgaacgtgtttatatttatcgatattagttcgtttttcgtgaatatgtttagttgttgcgggtttattatttttatgttggatttagggttttggagtttcgtcgttagttttgagttcgcgggtgagcggtttttttttgtgtttcgattttttttttttaaaattttataaagaaaaaagaaaaaaaaaaggtaataaaaattttaaaaggaagggaaaaattttttttttaatagaaacgattgttttatacgttagtttcggttgcgagtttaagttcggtgtagggtttgcggatcggcgggtatcgggggttcgggacggcggtttagacgcgagttttagtgggattcgggttttagaattgggagacggttcggttagggttaatttcgttttcggggattttggggaggtcggtcggggttttttagtgttaggttatttttcggggattttaggtttacggataagtatgaatacggtcgagcgtagtttttttcgggtcgtttattttataggtcgggttcgcgacgtcgttatttttcgggatttttatatttggagagtttaatttcgttgggggcgttttcggcgacgtttcggttttatcgtttgttttaggagtaaacgtttcgtcgcggacgatcgagcggatttttcggggggcgtcgattttcgtcggttcgggcgagcgttcggggggttgggggcgttcgggaggtttttcgtcgcggttaatagtttcgtttagggttggtcgttgttcggcgttcgcgagggttcgtattgggcgtttttcgagtcggttcgcgatttttaaggtggtcgtcggggttcggtaggcgttttttttttcgtaaacgtttgttcgagcgcgcgtttcgtttcgagtgtttttagcgttcggttcgcggggcggcgcggcggcgggggttttacggggttttcggcggtcgaggcggcgtaggtcgtaggtttcgggtcggggggttttcgaaggtgtcgggtttcgggcggcgcgtttttttcgtcgcggtcgtcgcgcgtgtggaggaggcggagcggcgaggggggtttagtttatttaaggtcgcggtagtaagtgtcgttattcgcgtttttttcgtcgtttcgcgttttattcgcgggcgtttcgggtcgtttttttttttcgcgttcgatacgtcgtcgttattttgtttatttttttttttttttttgcgtcgtcgcggatatcgtacgttcggtcgtagggtacgttttttcgcgaggacgacgtgtttattcgttggttgaatttgttattttcggttttttgttcgtttcgtcgtcgttgacgattggagcgtttggattcggtcgggcgttcgagcggcgattggtcggcgtttggtttcgttcgaggggtggatatagcgcgtttattggttttcggagacgttcgttacgggtagggggcgggaagtaggtatggggagacgaggttacggttgtgatttcggtggggttcgggaagggggtcgtaggttacgggtgttaacggtttttttgaacggtcgtagggtgggttgagttcggtgggcgggaatttgggtttgcggatttggaaggagcggggttatttttattagagtttttttttcgtatttttttttggggcgaggttaagggttaaaaagtaatataaagtggttaattttagttaaaaattttttttttgagttatttttggattaggggaaagagaaacgtttagggcggtttttgttttatcggaatttatgggggaagttttaggatagcgttgggataagtttagcgggggtttttcgtgaaaaataagagttgttaaaatatggtttgataaggttgaaaatattgaatttttttgtgttagtttcgtgttttttatttttttttgtattagcgttaggttgtttagttggaataaattattttggtataattttcgttttttggttttaagcgatttttttgttttagtttttttagtagttgagattataggcgtgcgttattacgttcggttaatttttgtatttttagtagaaattataggtgtatgtttgtaattttagttatttagaaggttgagggaggagaatcgtttgaattcgggaggaggaggttgcggtgagtcgagatcgtgttattgtattttagtttgggtaataagagcgaaattttgttttaaaaaaaaaaaaaagattttttttagaaaattgaagttgaaggaatattttttaatttaaatttattttggtattttttttttgtattgattgttggtttatattttaattttttggaatttggagataatgttggataattggtatcggtaggttttacgtttttttagagaattgtaggatatatggaagtgatttaggaaatatttggtgattattatagatagaatttttgaagatggatttttcgtttaaagattattttttttaagaattttttttagttatttttttaagtgtttggacggagatgtgttgtgagtgtgaattatatacggaatttttttgtttttttgatacgtataattttattataaaatgttaaaaaatgtagtattttaaaaaacgtaagatgtattgttgatattaatttttataagtgtgttgtgttgttatatataataaattttttaaaaattattaaatatttagggatattaggtagggtgcggtggtttatatttgtaattttagtattttgggaggtcgaagtaggcggattacgaggttaggagtttgaaagtagtttggttaatatggtgaaattttatttttattaaaaatataaaaattagttgagcgtggtggtatgtgtttgtaattttagttatttaggaggttgaggtaggagaattgtttgaattaggattcgggaggcggaggttgcggtgagtcgagattacgttattgtattttagtttaggtaataagagcgaaattttgttttaaaaaaaagaaaagaaaagaaaagtattttttgtatagagaattttatgagttatacgaaaatttgtatagttttatattgaagttaatattgagttgtattagaatttatatttttagtaaaataagtttattgtataggtattattaaaggatagttatttattttttatttttattttttttttttttatttttattttttttttttttttttttttttttattttttggtttgtttttttttgagttttttttttttgttttatttttgtttttagtacgatatgtagtaatattttttttatattttttttgtagtttaattgttttttgtttatatggttgtttatttttggttgattgtttagattatattttatttagtttttttgtagtttttacgataaataggtttgggtgtttatttttgatttttgggcgatgtttagagtaaaataggaagaaggtagatggtggttttttaggagtattgcgattttttttttttttttttttatttttttttatatttcggaggaatgtaatttttaatttttttgttatagcgagttttgttattttttgttttttttttaaattttattttttttttgtagacgtggttttttatttttttaaatattttttggagaattttacgaaattgatagaagagttcgggtgtttttttttgtgttttttttggtaggtttgcgcg

SEQ ID NO: 220 - DNA, 4616 bp, Artificial Sequence
  chemically treated genomic DNA (Homo sapiens)
tgaaatggttttatttttttttagtttgtttaagttaatggagttttattagaatgtgagttataaaatagtagagttattttttatttaatgttgtatttgtagggtttagaatagtatttgaaggattggcggaggtttaataaattgttaaaagggtagattagttaggtgtgatggcgtgtgtttgtagttttagttatttgggaggttgaggtaggaggattatttgattttaggatttttgggttgtagtgtagtatattagttaggtgtttgtattaagttttgtattaatttggttgtttaaggatggttgaattgatttaggtggaaattggagtaggttaaaatttaatgttgattagtaatagggtcgtatttgtaaatagttatcgttttttagtttgggtaatatagtgagattttatttttaaaataaattttaaaaataattaattagaaaaaaaaattagtttgtaattttagtattttgggaggttaaggcgggtagattatttgaggttaggagtttaagataagtttggttaatatggtaaaattttaatttttattaaaaatataaaaattagttgggcgtggtggtaggtgtttgtagttttagttatttaggaggttgaggtaagagaatcgtttgaatttgggaggtggagattgtagtgggtcgagatcgcgttattttattttagtttgggtagtagagtgcgattttgttttaaaaaaaaaaaaaaagaaagaaaagaaaagaaaaagaaaagaaaagaaaaaaattgggaggtttaagtttatttttggtgtttttatatttttttgttttatttttttgtatttagtttttttttgtaatttgtgttttatattagtttttaagtttttaacgtgatttagtatgagaattggattttgttatttttttgtttataatattttatgttttttttttgtttagaatattattttttttattgtttttattaatggaattggtatttttttaaggatatgattaaatttgtttatttttatattattttttaaagtagaatttatttttttttttttaatatgatgatattgatagggtttgtttttatttattagattgtgagttgtttagggtaggtagcgttttttgtttttgtttttgttttttttttttgagatagggttttgttttgttatttaggttagagtgtaatggtatagttttagtttattgtagttttaatcgtttcggtttaaattattattttattttagttttttgagtagttgggattataggtatatgttattatatttggttaatttttttgtatttttagtagagatagggtttggttatgttgttcgggttggtttcgaatttttggatttaagtaatttatttattttagttttttaaaatgagggatcgtgttttatttatttttatgtttttagtttatagtttagtgttggatttatggtagtattaaataaatatttgttgaatgtaatagtaaatagtattttagggagtaagaattagattaataaaggtggtaaaaggtttggagaaaaaaataatagtttaatttggttagagtatgagggagagtagtaggagataagatggaaaggttttttgggtaaggttttgaaggaagttggaagttagaagtatataatgtgtatatcgtggtaggtagtggggagttaatgaaggtttttgagtaggagagtaatgtgttgaaaaataaatataggttaaatttattagagtttttttgatatatatatttgttttttatttaagtttaagtttgttttttatatatttattatttaatttattttcgggtttttttagtagtttgttttatttttttatttgttttttggtggagttagggatgtatatatgagttgtttttttttttagttagaggatatgggggttttagtttttttgtttttttttttttgtgtttggagttgggaagtaggttagggttagttgaggttggttggtaagtagttgggtggtgttagggagagtttgtatagtgttaggtggtgttttgggttttaagttgagtttatggtttcgataattttttgtttgtgtatatatttgttttttattttatttttattttagttttggtatgggggagagggtatagggttagataaatttgtgagattttggttttatttttgtaaaagggcgttttgtgagttagtttgtttttttttaggtttgttttttttttatttagttttcgtttttaatgtacgtatagttcgtatatatcgtgtgttgggatattttatagttagtcgtatggtttttttgtgttttagtttttggttttttttgttgatttcggtttttgttttaggttttattgtgtaattgttgttgttattgttgtttttggtgtttgtttatttttagaggttgtttcggatgtaggaggatttttttttgggaggaggtttttttggggaagatgatttattgggcgaggaggatttgtttagtgaagaggatttatttagagaggaggatttattcggagaggaggatttatttggagaggaggatttatttggagaggaggatttatttgaagttaagtttaaattagaagaagagggttttttgaagttagaggatttatttattgttgaggtttttggagatttttaagaattttagaataatgtttatagggataaagaaggtaagtggttattaatttttaaatttaggttttaggaggtttatgattttttttttatattttagtttaggttttgtttatttagggaaggaggggagattgtattttttatagaagtttttttagaggttttatattaatatttttatttttattttcggaggtagaaagggatagatgtggagagaaaataaaaagggtgtaaaaggagagaggtgagttggatgagatgggagagaagggggaggttggagaagagaaagggatgagaattgtagatgagagaaaaaatgtgtagatagaggaaaaaaataggtggagaaggagagttagagagtttgaggggaagagaaaaggaaagtttgggaggtgaagtgggtattagagataagtaagaagagttggtagaagttattttattttaggttataatgaggaaattgagatttaggaagaagggatatagtaggtagagaaacgtggttttttgatttttaagttaggaatttggggaaaggggttggagattatataaggtagagggatgagtggggagaagaaagaagggagaaaggaaagatggtgtatttatttatttgggatttaggattgaagtgtttatttattttttttttttttttttttgagataaatttttatttttgttgtttaggttggagtgtaatggcgcgatttcggtttattgtaatttttatttttcgggtttaagtgatttttttgttttagtttttagttaagtagttgcgattataggtatgcgttattacgttcggttaatttttgtatttttagtagagacggggtttcgttatgttggttaggttggtttcgaatttttgattttaggtgatttaattattttggttttttaaagtgttgggattataggcgtgagttatagcgtttggtttgaagtagttatttatttttatagattttaagataatgattgtaagttggtaggattgttgtttggtttatttagttgcggtgttgagtttgggtgcggttttttgtgttttgtatttggttcgtttaaggtatttgttattcgtaatgtttttgtaaggtatttgcgtttgtgatatcgttttggtcgttaggaagggattggggttttaagtttgagcggtttattttttttatttatataggggatgattagagttattggcgttatggaggtgagatatttattcgttgtatagatttaatttgggaatttagttttgtggattttttttatagtcgtttttgaatattggtttcgggcgttttattcgtcgtttatcgttttatttttttattttttttattcgggttttttaagtttttgatttaggcgttagatttttttattatatttttttattttaggcgattcgttttggtttcgggtgtttttagtttgcgcgggtcgtttttagttttcggtggatattcgtttttagttcgtcgttttttgttcggttttgcgttttttggaatttttgggtttttagttttcgtcgtttttagaattgcgtttgcgtaataatggttatagtggtgagggggttttttcgtcgagatttggggatggggcggggcgtagggaagggaatcgtcgcggtagtgtttgttcgggggttgggttggttttatcgggcggggtcggtttatttgtttttttttacgtagtgtaattgattttgttttttgggttagagatggttttgggtttcgggcgggagtatcgggttttgtagttgtatttgtattggggggttgtaggtcgttcgggttcggagtatattgtggaaggttatcgtttttttgtcgaggtgagcgcggagttggtcg

SEQ ID NO: 221 - DNA, 4616 bp, Artificial Sequence
  chemically treated genomic DNA (Homo sapiens)
cggttagtttcgcgtttatttcggtagggaaacggtggttttttatagtgtgtttcgagttcggacgatttgtagttttttagtgtagatgtagttgtagagttcggtattttcgttcgggatttagagttatttttagtttaggaggtagggttagttgtattgcgtagggagaggtaagtgagtcggtttcgttcggtagggttagtttaattttcgggtaggtattgtcgcgacggtttttttttttgcgtttcgttttatttttaagtttcggcggggagatttttttattattgtggttattgttgcgtaggcgtagttttgggagcggcgggagttggaagtttaggagttttagggggcgtagggtcgggtagaaggcggcgagttgggggcggatatttatcggggattggaagcggttcgcgtaggttggggatattcggggttagggcgggtcgtttggggtgggagagtatagtgaggaagtttgacgtttaggttaggaatttagggaattcgggtagaaaaggtgagggggtgggacggtgggcggcgggtgggacgttcgggattagtgtttagggacggttgtaggggagatttatagagttgggtttttagattgggtttgtgtagcgggtgggtgttttatttttatagcgttaatgattttggttattttttgtataaatgaaaaggatgaatcgtttaagtttagagttttaatttttttttggcgattaaaacgatgttataaacgtagatgttttataggagtattacgggtaataaatgttttaagcgggttaggtgtaaagtataggagatcgtatttaaatttaatatcgtagttgggtgggttaaatagtaattttattagtttgtaattattgttttagggtttgtaaaagtgagtggttgttttaggttaggcgttgtggtttacgtttataattttagtattttgggaggttagggtggttggattatttgagattaggagttcgagattagtttgattaatatggcgaaatttcgtttttattaaaaatataaaaattagtcgggcgtggtggcgtatgtttgtaatcgtagttatttggttagaggttgaggtaggagaattatttgaattcgggaggtggaggttgtagtgagtcgagatcgcgttattgtattttagtttgggtaataaaagtgaaagtttgttttaaaaaaaaaaaaaaaaaaagtgagtgggtattttagttttgagttttaaatgagtgagtatattattttttttttttttttttttttttttttttatttatttttttgttttgtatggtttttaatttttttttttaaatttttggtttgggagttaagaagttacgtttttttatttgttgtgttttttttttttaggttttaatttttttattgtagtttaagatgagatgatttttattagttttttttgtttgtttttggtatttattttattttttaagtttttttttttttttttttttaaattttttgattttttttttttatttattttttttttttgtttgtatatttttttttttatttgtagtttttattttttttttttttttagtttttttttttttttttattttatttagtttatttttttttttttgtattttttttattttttttttatatttgtttttttttattttcgagagtggggatggggatattggtatgggatttttggaagggtttttgtggggagtatagttttttttttttttttgagtgaatagagtttaggttggggtatgggaggggagttatgaattttttggaatttggatttggagattgatgattatttattttttttgtttttgtgggtattattttggggtttttgaggatttttaggagttttaatagtaggtagattttttaattttagggagttttttttttttgatttaggtttaattttaggtagatttttttttttaggtagatttttttttttaggtagattttttttttcgggtggatttttttttttgggtgaattttttttattgggtagatttttttcgtttagtgggttattttttttagaagagtttttttttaagggggaatttttttgtattcggggtaatttttggggatggataggtattagaagtagtagtgatagtagtagttgtatagtgaggtttggagtaggggtcgggattaatagagggagttaggggttggggtataggggagttatgcggttgattgtggggtgttttagtatacggtgtgtacgggttgtacgtgtattggaaacgagagttgggtgggggaggagtaagtttggaggggagtaggttgatttatagagcgtttttttgtagagatggagttaaagttttataggtttgtttggttttgtgtttttttttttatattaaagttaggatgggggtggagtgaggggtaggtgtgtgtataggtagaaggttatcggggttatggatttagtttggaatttaaggtattatttggtattatgtaggttttttttggtattatttagttgtttgttagttagttttagttaattttggtttgttttttagttttaggtatagaaggggaaaggtaggggagttggggtttttatgttttttggttgagagggaaagtagtttatgtatatatttttgattttattaggaagtaggtaaagaggtagggtaggttgttaggggagttcgagggtgagttaagtaatgggtatgtgggagataaatttgagtttgaatgaaaagtaagtgtatgtgttagaggggttttgataggtttaatttatatttattttttaatatattatttttttgtttaaaagtttttattggttttttattgtttgttacgatatgtatattgtgtatttttgatttttaattttttttaaaattttgtttaagagatttttttattttgttttttattatttttttttatattttagttaaattaaattattatttttttttttaaattttttattatttttgttaatttagtttttgttttttgaaatgttatttattattgtatttaataaatatttatttagtattattataggtttagtattgggttatggattagggatatggaaatgaataagatacggttttttattttgggaggttgaggtgggtggattgtttgagtttaggagttcgagattagttcgggtaatatggttaaattttgtttttattagaaatataaaaaaattagttaggtgtaatggtatgtgtttgtagttttagttatttaggaggttgaaatgggatgatggtttgagtcgaggcggttgaggttgtagtgagttgagattgtattattgtattttggtttgggtgatagagtaagattttgttttaaaaaagaaaaataaaaataaaaataaaaaacgttatttgttttgagtagtttataatttagtgagtgagggtaaattttgttaatattattatattgagggaagagagatgaattttgttttagaagataatatagaagtaggtaaatttgattatgtttttgaagaaatattagttttattggtaaaaataatagggagaatgatattttgggtaaagggaaggtataaaatattatgagtaggagagtgatagaatttagtttttatattaggttacgttgagggtttgagggttagtatggagtatagattgtaggggaagattgggtgtaaggagatggggtagaagagtgtgaggatattaagaatgggtttaggttttttagtttttttttttttttttttttttttttttttttttttttttttttttttttttgagatagagtcgtattttgttatttaggttggagtgaagtggcgcgatttcggtttattgtaatttttattttttaggtttaagcgatttttttgttttagttttttgggtagttgggattataggtatttgttattacgtttagttaatttttgtatttttggtagagattggggttttgttatgttggttaggtttgttttgaatttttgattttaggtgatttgttcgttttggttttttaaagtgttgggattataggttggtttttttttttaattaattatttttaaaatttattttagagatgggattttattgtgttgtttaggttggagggcggtggttatttataggtgcgattttgttattgattagtattgagttttgatttgttttaatttttatttgggttagtttaattatttttaggtaattaggttgatgtagaatttagtgtagatatttgattggtatattatattatagtttagaaattttgggattaagtgatttttttgttttagttttttaagtagttgggattataggtatacgttattatatttggttagtttgtttttttaataatttattaagttttcgttagttttttaggtgttgttttaggttttatagatgtagtattgaatagagaatagttttattgttttgtagtttatattttagtaaggttttattggtttaaataaattaaaagagaataaggttatttta

SEQ ID NO: 222 - DNA, 4374 bp, Artificial Sequence
  chemically treated genomic DNA (Homo sapiens)
tcggcgtagtagtgggggaggggatcggcgagaggggaggaaggaaggggggaggaagggggagatttgtttgaatattgtaataaaaataaagcgagaagaaagaagcggatttatttttatgaggtattttttttggttgttatagtttttgttaagagttttgtttggttggggttttttgtgttgttgttgttgtttgaagattataatggtttgaaatgacggtgttttaaaggagttgttggtgagagttttttttacggatgttgttgggttggtgtgtgagagtaatttttagatttttgggaaggagatagagattgataataaaatgggttgttagcggttggagagtgagagataaagagtgtgggtgagggaagtggttgtagttagtatatttatgttgattggtgatggtttaagtgtgttaatgtgtgtgtgtcggcgttcggtttcgtttttatcgttttttattggtttattagcgaagtttgatttttgttattattttttagtaaaatatttttttttgcgtttgaattagagcgggaaatgaggtcgagttacggttttttttttaaatttattaattatttcgtaatatgtaaatgtatcgttcgtttttatataaaatattgttttatgtaaagtagcgtcggggtttcgcgttagtcgattggatgtttttttttttcgtttggtgtaattggttcgtttgtttgaatatgaatatatttgttttcggtttcgtcggtgggtttcggttttttttttcggcgtagggttttcgagttcgggttttggcgttcgtttgtattttttcgtttcgcgtacgtcgagattcggcgcggttcgttttgttgtcgcgaatttgagcggttaagtgaaggtttttgggttgggggtcgcgtttttattttttttaagttggattcgggatttttagttttcggagggtgtaagtttttgtgttgtttttttttgttaattttaggatagcgtggtttgtcgtttcgttttcgttcgtttttattttattttagtcggggttttaagatatagagtatagcggcggtcgtattttagtttatttggttttttggaagaagaggaaaggggcgggagcgttattgggttttggtagttttattttagttgcggaggtcgcggcgaagtttaggtcgagaggaggttgtcgggtcgagaattaaacgaggttagaggtttttttagtttaagtttttagggtttgtttaaattttttatttcgtttttttcgtttttttttttttttttttttttttcggaagtcgcggtgcgtagcggagtagaggtatagttttggttggagaggttcgagtaaatacgttatttattttgtgtatagagggtttttgtgaaaagttttgaagagtttttattaaatatttattaattttttttacgtgttatttgttgattaagtgcggttgtttttcgtagcgttcgagaggaggggaagttaggggagataagaggggagggggagtggaagtttgggtgggggggcggatgattaatgttgggagggattttttttttttttttgtgtgtgtgtgtgtgtgtgtgtgtgtgtgtgtgtgtgttttattggcgatgtcggtatgttagcgtgtgtcgtgtgtgttatcggttatttgtgtgtggtgcgtgtgttttcgtattacgatttttttttttgggtttgtttagtttacggaggtagtttttttttagttgttgttagaaaatcggggaggaaagtaagtaaatggttttttttttttgattatatattagaagtttatttgttgaatgtcgtacgattaggatatattttagtatattttaaaggcgtttttcggagtttgtagttaaggtgataggagagcgagcggttgtttggttttgcgttgtttcgagttttttcggcggtttcgggttacggagtcgggaaggagaaggaaggtttgggttgttgtatatattttaggatagggcgagggggaatagggttgaagagttgaggtagggaggttgaaatgaagtagtcgaagggtacgttagattttttttgatttagggaaagtgttgaaagttagagtttattaataaaatttgcgcgatttgaattcgttgttgattggtcgcgtcgtcgtagtttttggtagtcgggatagtgaggacgttgtaagtcgttttgggtcgtcgggttatatgtgggttttattttttcgtttttgtttgggatttagtagttttgcgattaaggagttcgggtagggttttcgggaagtaaaggttttttcggttttagttagaggtggggtcgtataattttttttttttttcgggttggggagggttgtcggttttaattttttttcgggagttcgtagcgtcgggaggaaatttgggttagaggtgaaggaggtggcgtcgggtgtttaggttcgcggttttttgggcgaggttttatttcgtaggagcgcgattttcggaggatgtcggtaagtggggtcgcggttttgagttttagattagcgaaagtcggttttttttttttttttttttttattttttaagcgagtattaaagaagtttggatttaagatttaagttcgttgtgtatgagcgagggatttgcgggggggcgggggggggggaagtgattttgttcgaattggaggcgagtattatttttataattttttaattagcgatcgagtggattagtatttttttaagttttgtttcggaaagaagtagtcgtaattttgttgttatttttttttagggtattggttttttgaattagtttttttttttatttttttaatttttatttcgttgcggagaaaagttttaataaaaaattagaaaaggtaaggagcgaggagtgaatgttattgacgttattgggtggggaagggggtttcgggaaagatttttggaaattttttcgtataaataaaaaataaaaaggatttggttgttttttatgtgttaatatttggggaggggagtttaattttagaatgaggtcgagtttttaaagtttaaggagagaggggtgagagtgagattttttcgttttttttggattggttttaaggaaggtgggggtgttgttttatttcgtggggagttttattttttttgttaagtatcggttttgggggcgaagcggtttaggggtgtgggggtcgagattgaggtgcgggcgcggttgttagaggtgtgtataaaatcgagataattcgtaggtcgttattttaattgcggttattaatacgttcgaggtttatttgttgttttttaagacgcgggggggcggcggggattgcgttttaggttttgtttttttttttcgtttttttataggtttttgtttttttttatttttcgttttttgtggttagagggaggattttttaggtcggcgggtgcgttttcgcgggggtcgtcggggtcgttttattcggtagcggggttgtttgcgtggagggagtttcgttgggggatcgtggttcgttagagtttgtttagagtttttagttagtattgatgcgttaatatgaggtgaggtaagtattttattcgtatcgatttttggtatttttttgtgtttattttattaggttttcggggaggtaaagaagtgtttatttttggggggaagtgtttttagtttttagttttagaattaagagttttttattcggagttttgatagttttgatatttttaaatttttttttttttcggttaagtagaggcgtagcgtcggcgcgttggaaagggtgaagattggtattttttggagaaggaaagttttggtagatatttgcgttattttgtagtgttttaaacgtttttttttttgtagattttgggaaggtgggattttttgttcgcggagttggtaaacgggtttagtgagttttaaaggtaaaggtttttatttcggtcgtttagtttttggtgttttttttatttttaggtttttgttttttttttttttttagtaatttgtcggttttcgttaattcggtagtttcgtcgagtttagagtttagaaaagttaagaagattttagagtcgtttcgtggtatttttaggttgtggttattgttcggtttggggggaagtcgcggtgttttcgttttttttcgttttttgttaaatggttagtgttaggggttttttgggtttagtttttagttttttttcgttcgttttgggaggttagtttgtttttttttttttttttttttttttttttttttttttttttttttttttgttttttttttgtttatttttaaaatatttttaaaataatattgt

SEQ ID NO: 223 - DNA, 4374 bp, Artificial Sequence
  chemically treated genomic DNA (Homo sapiens)
ataatgttattttaaaggtattttgggggtgggtagggagaagatagagagagaaagagagagagagagagagagagagagagagagagagagataggttggttttttagagcgaacggaagaggattgaggattgaatttagggagtttttagtattggttatttggtaggaggcgaggaagggcgagggtatcgcggtttttttttaagtcgagtagtggttatagtttgaaggtgttacggggcggttttgggatttttttggtttttttaggttttgggttcggcgaggttgtcgggttagcgggaatcggtaggttgttggagaaaggagagggataaaggtttggaagtgggggaggtattagggattgggcggtcgggatgggagtttttgtttttagggtttattggattcgtttgttagtttcgcggataagggattttatttttttagggtttgtaaaaagagagacgtttggggtattataaagtgacgtaggtgtttgttaagattttttttttttaaaaaatgttagtttttattttttttagcgcgtcggcgttgcgtttttgtttgatcggggaaagagagagtttggaggtgttagaattgttagaatttcggatgggaggtttttggttttgaagttgggagttggaggtatttttttttagaagtgggtatttttttgttttttcgaaggtttgatggggtgggtataggggaatgttagggatcggtgcgggtgagatgtttgttttattttatgttgacgtattaatattggttagaagttttgggtaggttttggcgagttacggttttttagcgggattttttttacgtagatagtttcgttatcgggtgggacgatttcggcggttttcgcgggaacgtattcgtcggtttgagaggttttttttttggttatagggggcggagggtaggggggaataggggtttgtggggaggcggggaaaggagatagaatttaaagcgtaattttcgtcgttttttcgcgttttggagggtagtaagtgggtttcgggcgtgttggtagtcgtaattaaaatggcgatttgcgagttgtttcggttttgtatatatttttggtaatcgcgttcgtattttagtttcggtttttatatttttaggtcgtttcgtttttagagtcggtatttggtagagggagtgaggttttttacgaggtagaatagtatttttattttttttgagattagtttagagagaacgaggaaattttatttttatttttttttttttaaattttgaaaattcggttttattttggggttgaatttttttttttaaatattgatatatgggaagtagttaagttttttttgttttttgtttgtgcggaggagtttttaggagtttttttcggagtttttttttttatttaatgacgttagtggtatttatttttcgttttttgttttttttgattttttgttaaaattttttttcgtagcgagatgggggttggaggggtgggagaaggagttgatttaaagagttagtgttttggggggaaatagtaataagattacggttgttttttttcgaggtaaagtttaagaaggtgttaatttattcggtcgttaattgagaggttgtaaaaatgatattcgtttttagttcggatagaattatttttttttttttcgttttttcgtaagtttttcgtttatgtatagcggatttgagttttgagtttaagtttttttaatgttcgtttggaaagtaaaaggagagagaaagagaaagtcgattttcgttggtttgggatttagggtcgcggttttatttgtcggtatttttcgaaagtcgcgtttttgcgaaatgaaatttcgtttaggaggtcgcggatttggatattcggcgttattttttttatttttgatttaggttttttttcggcgttgcgagttttcggggaagggttagagtcggtagttttttttagttcggggaggggagagggttatgcgattttatttttggttagggtcggggaggtttttgtttttcgggagttttgttcgggttttttggtcgtagggttgttgggttttaggtaggaacgagagggtgaggtttatatgtggttcggcggtttagggcggtttgtagcgtttttattgtttcggttgttaggggttgcggcgacgcggttagttagtagcgagtttaggtcgcgtagattttattgatgagttttgatttttagtattttttttaagttaagaagagtttagcgtatttttcggttgttttattttagtttttttgttttagttttttagttttattttttttcgttttgttttggggtgtgtatagtagtttaggttttttttttttttttcggtttcgtggttcgaagtcgtcgagagagttcgggatagcgtaggattaggtagtcgttcgtttttttgttattttaattgtaggtttcgaggggcgtttttggagtgtattgaggtgtgttttaatcgtgcggtatttaataaatggatttttggtgtgtggttagaagagaaaagttatttatttattttttttttcggttttttggtaatagttgaaggggagttgttttcgtggattgagtagatttaggagagggagtcgtggtgcggagatatacgtattatatatagatgatcggtggtatatacgatatacgttgatatatcgatatcgttagtgggatatatatatatatatatatatatatatatatatatatagagagagagagagaattttttttagtattggttattcgtttttttatttaggtttttattttttttttttttttattttttttggtttttttttttttcgggcgttgcgaaaagtagtcgtatttagttaataaatggtacgtgggagaagttggtgagtgtttggtgaggattttttagggttttttataagaattttttgtatataaagtaagtggcgtgtttattcgggtttttttagttagagttgtgtttttgtttcgttgcgtatcgcggttttcgaaaggagaaaggagagaagaaagggcggggagagcggggtggaggatttggataggttttggaggtttgggttggggaggtttttggtttcgtttagttttcggttcggtaattttttttcggtttaggtttcgtcgcggttttcgtagttggaatggagttgttaggatttagtgacgttttcgttttttttttttttttttaaggggttaggtgggttggggtgcggtcgtcgttgtgttttgtgttttggggtttcggttgggatggggtgggggcgggcgggggcggggcggtaggttacgttgttttggagttggtaagaaaggatagtatagaaatttgtatttttcgaggattgggagtttcgagtttagtttagggggagtgggggcgcgatttttaatttagaaatttttatttgatcgtttaagttcgcggtagtagggcgggtcgcgtcgaatttcggcgtgcgcggagcggggagatgtaggcgagcgttagagttcgggttcgggggttttgcgtcggggagaggagtcgggatttatcggcggagtcgaaaataagtgtatttatatttaaataaacggattaattgtattaggcggggagagggagtatttaatcggttggcgcgaggtttcggcgttgttttgtataaagtaatattttgtgtgagagcgagcggtgtatttgtatgttgcggagtgattagtgggtttgaaaagggaatcgtggttcggttttatttttcgttttggtttaggcgtaggaggaagtgttttgttggaggatgatgatagaggttaggtttcgttaatgggttagtgaggagcggtggaggcgaggtcgggcgtcggtatatatatattaatatatttgagttattattaattagtataggtgtgttggttgtagttattttttttatttatattttttattttttattttttagtcgttgatagtttattttattgttaatttttgttttttttttaggaatttgagaattgtttttatatattaatttagtaatattcgtggagaaaatttttattagtaatttttttaaaatatcgttattttaaattattgtggtttttaagtaataatagtagtataaaaaattttaattaaataaaatttttgatagaagttgtgataattagaaaggatgttttataaaggtgagttcgttttttttttttcgttttatttttattgtaatatttagataggtttttttttttttttttttttttttttttttttttcgtcggtttttttttttattgttacgtcgg

SEQ ID NO: 224 - DNA, 2534 bp, Artificial Sequence
  chemically treated genomic DNA (Homo sapiens)
aggtaggaaagtgggatagtcggggagttggattttattttttgtgagtttcgttggtatttgatggtatgtggtttggagagggtaggtgatttggcgtggagggttagagggtaaatttttaaataagtggtaataggttattaatttgaaagggaaaattgtgtagtgatgggaaatgtgtttaataaatttattgggtgattaattataaaggttgggttggagttttagaggttgtttgttaaatattttattaagcggtattttgaaagttgttatttgcgtattttgggagtttagaggggattttgagggggaatgaggtttggaggatggaattatttttaggtagattgagaaggagtttggattttatttttaaatatagtttggagtttataggttagaggttttaatgggagaaaagttaaaggaagagggtgtagaaaggagttttagggaattggtggttatgtgattttgagtaaattttatttttttttgagatttagtgtttttatttttatggttttgtgtgtgttatagagatatggtggggattaaattcgatcgtgatatgaaagtgtttgggaaattttatggttttatttaaatatgagttatttttatttgaattaaggggggaagttatttggtaggattaggaattttatttttttgaatttttatgggttttgtcgaggttgaagtagttaggggttaaagttagtttttagtttttggaagggtattgtgaaagtggatttgatttgagaagtcgttttttgatgtgggtagttatgtgatgttagtttcgaataagagggggtagtttggagtttggaaaggtgttagtgtaggtggggtttacgtttagattttttttgttgattgttttgatgatttatttttatattttagtttttttatttttattgtagagtcggaaagggtgtggggaagagaggagagggaggtaggttttgggttttggtttcgttttttgtttttttttatttttttttgggtttggttatttagttaaaaggtaggttaagagtaggagagatatagagttcggtattggttttaggtagtagttagttcgtcgttcgtttgtgtgtttttagagttatggagagagttagtttgatttagaaggttaagttggtagagtaggtcgaacgttatgaggatatggtagtttttatgaaaggcgtcgtggagaagggcgaggagtttttttgcgaagagcgaaatttgtttttagtagtttataagaacgtggtgggcggttagagggttgtttggagggtgttgtttagtattgagtagaaaagtaacgaggagggttcggaggagaaggggttcgaggtgcgtgagtatcgggagaaggtggagattgagttttagggcgtgtgcgatatcgtgttgggtttgttggatagttattttattaaggaggtcggggacgtcgagagtcgggttttttatttgaagatgaagggtgattattatcgttatttggtcgaggtggttatcggtgacgataagaagcgtattattgatttagttcggttagtttattaggaggttatggatattagtaagaaggagatgtcgtttattaattttattcgtttgggtttggttttgaattttttcgttttttattacgagatcgttaatagtttcgaggaggttatttttttggttaagattattttcgacgaggttatggttgatttgtatatttttagcgaggatttttataaagatagtatttttattatgtagttgttgcgagataatttgatattgtggacggtcgataacgtcggggaagaggggggcgaggttttttaggagttttagagttgagtgttgttcgttatcgtttcgttttgttttttttagttttttattttgtcgagaggattagtatggggtgggaggttttattttttttttttaggcgttgtttttgttttaaagggtttcgtggagagggattggtagagttgaggttatttggggttggggattttattttttttgtagttgttgagcgtatttaattattggttatgtttttatttttgtttttcgtattcgttttttttcgattttaggattaggttattttttttttttttttgttttttttttgtttttgttgtttttgatcgtaggaattgaggagtgtttcgttttgtggttgagaattggatagtggtaggggttggagatgggtgtgtgtgtgtgtgtgtgtgtgtgtgtgtgcgcgcgcgttagtgtaagatcgagattgagggaaagtatgtttgttgggtgtgattatgtttttttttaataaagtttttttgtgatattttttttgttttttttttagtttttggcgatgggttgggagtgggattggaatttgatttagagattttgattttggatttttgagttagggttttgaattttttaggtggtttagtggttcgtacgtaagattttgagtttaggtgaggtcggggttt

SEQ ID NO: 225 - DNA, 2534 bp, Artificial Sequence
  chemically treated genomic DNA (Homo sapiens)
ggatttcggttttatttggatttaaagttttgcgtgcgggttattgagttatttagggagtttagggttttaatttagaggtttaaagttagggtttttaagttagattttagttttatttttagtttatcgttaagaattggaagagagataggaggagtgttataggggaattttattgagaggaaatatggttatatttagtagatatgtttttttttagtttcggttttgtattggcgcgcgcgtatatatatatatatatatatatatatatatttatttttagtttttgttattgtttagtttttagttataaggcgggatattttttaatttttacgattagaggtagtaggggtaggagggaggtaagaggaggggagaagtagtttggttttggggtcgggaggaagcgggtgcggagagtaggggtgggggtatgattagtggttaggtgcgtttaatagttgtaagaagagtgggatttttagttttaggtggttttagttttgttagtttttttttacggagttttttggagtaagaatagcgtttaggggagaagggtggggttttttattttatattagttttttcggtagggtgggggattggagggggtagggcggggcggtggcgggtaatatttagttttggggtttttggggagtttcgtttttttttttttcggcgttgtcggtcgtttatagtgttaggttgtttcgtagtagttgtatgatgagggtgttgtttttgtaggagttttcgttgagggtgtgtagattagttatggtttcgtcgaaagtggttttggttagagagatggttttttcggggttgttggcgatttcgtagtggaagacggaaaagtttagggttaggtttaggcggatggggttggtgggcggtattttttttttgttgatgtttatggttttttggtaggttgatcgggttgagttaatgatgcgttttttgtcgttatcggtggttatttcggttaggtagcggtagtagttattttttatttttaggtagaagattcggttttcggcgttttcggtttttttgatgaggtggttgtttagtaggtttagtacggtgtcgtatacgttttggagtttagtttttattttttttcggtatttacgtatttcgggttttttttttttcgagtttttttcgttgtttttttgtttaatattggatagtattttttaggtagttttttggtcgtttattacgtttttataggttattgagagtaggtttcgtttttcgtaggagagtttttcgtttttttttacggcgttttttatgaaggttgttatgtttttatagcgttcggtttgttttgttagtttggttttttggattagattggttttttttatggttttggggatatataggcgggcggcgggttaattgttgtttgggattaatgtcggattttgtgttttttttgtttttggtttgttttttggttgggtggttaggtttagagaagggtggggaggagtagggggcgggattagggtttaagatttgtttttttttttttttttttttatatttttttcggttttgtagtaaaggtaaaaaggttgggatgtgggggtgaattattagaatagttagtaggagaaatttgggcgtgggttttatttgtattggtatttttttaggttttaggttgtttttttttgttcggggttggtattatatggttgtttatattaggaaacggttttttaaattagatttatttttatagtgtttttttaggggttaaggattggttttagtttttggttgttttagtttcgatagagtttataaaggtttaggaggatggggtttttaattttgttaggtaatttttttttttggtttaggtgaggataatttatgtttaggtagggttatggagttttttaagtatttttatattacgatcgaatttaatttttattatgtttttgtgatatatataggattatagagatgggaatattaagttttagagaggggtgagatttgtttaaagttatatagttattaattttttgaaatttttttttgtattttttttttttagttttttttttattgaggtttttgatttatgagttttagattgtgtttggaagtgagatttaggtttttttttagtttatttgaagatggttttattttttaggttttatttttttttagggttttttttgagtttttagaatgcgtaggtggtagtttttagagtgtcgtttaatgaagtgtttaataagtagtttttgaagttttagtttagtttttgtaattagttatttagtaggtttgttggatatattttttattattatataatttttttttttaagttggtggtttgttgttatttgtttgaggatttattttttggttttttacgttaggttatttgttttttttaagttatatgttattaggtattagcggggtttatagagggtggggtttagtttttcggttgttttatttttttgttt

SEQ ID NO: 226 - DNA, 10001 bp, Artificial Sequence
  chemically treated genomic DNA (Homo sapiens)
ttaagggatttgtttgttttggttttttaacgtgttggaattataggtgtgagttatcgtgttcggtttaataaggaattttttaaataaagttttgcggggtcgattagattaatttatattttttgagtagattttggtataatttattatttgtagtattgaatgttaaggtttgttttttattttgaaattatatttttttttttttattggaattgaaattttatttttttatgaaatgatagtgatggtggatggtatttgttttttttaatatttttatttgataaaataaaagttagtaatttatttcgatttttaattttttgttggtgtttgaaattttaaaattgagatttaaagtatagttttggttttggagagatttttaggagagttagagtttagaagggagtaggatttaggaggtttttattttttagtattttagttgagttagtcgggttatggaatattattgagtaattaaaatattattaatagataaaaaaagtttattgaatataaaatttaaaggtattaatagttttgggtttaagagatttatggtaggaagttaagagttttgttttagggtcggtttgggtagttttggaagaagttattgtatatgatagtgatgagtgttaggaaaatagtatatttttggaagtttatttgttggttattgtttttatttaggttgtttattagtttttttagtttttttttatttatttttttttgaaagtgataggaaatatatttattattaagttagttttaattttagttttattaaatatttagatttttatatatttaggttggtttttagttttttttttttattgggtagttgggtataaggtgggtaggaggttttgggagttattaagagggtttagtgagtaaggagagagatagatatttattggtgagtatttttagtgtgttttttttttggatatagggaggatattggatgtttttttgagtatgtattagttcgaattttataggagtttagcgaggtaggtattattattttattttgttgatgaggaaatcgaaggttgttgttttttaatattagttaggtagatttagaaaagaatattttttattttttaagataaggttttgttttgttgtttaggttggagtgtagtggtataattataatttattgtagttttaattttttgggttttagtaatttttttattttagttttttaagtagttgggattataggtttatgttattatatttagttaattgtttatttttagtagagataaggtttcgttatgttgtttaggttggttttggtaattagagtgattttattttgttatttaggttgtattatagtttattgtaattttgaatttttgggtttaagtaatttatttaagtagttgggattataagcgtatgttattatgtttggttaatttttatttttatttttgtagagatggagttttgttatgttgtttaggttggtcgaatttttgggtttaagagatttttttgttttagttttttatattgtggggattataggtataggttattgtatttagttgaaaaatatttttttaatattagtcgaaataattagaaaaatttaattagttataaaaataaaattaaaaaaaggaaagaaggatttgttttatgtgtttaaagtttgatatttaattttgggaattattaatgagttagtatagggagggtgagggataaattgaaggtcgatgtatttttttataaaatgttttagattatatattttagttgggtttttttatttttatatatttttttagtttggtatataaaaatggaaagaggttaagtatagtgttttatatttgtaattttaatattttgggaggtcgaggtgggaggattgtttgaatttaggagtttaagtttagtttggataatatagtaagattttatttttataaaaataaaaattggttaggtatggtgataatatttttgtagttttaattatttgggaggattgtttgagtttaggagttcgagattatagtgagttatgatttagtttgggtgatagagtgagattttgtttttttattataaaaaaaaaaaaaaaaaaaaggagttcgggtacggtggtttacgtttgtaagtttagtatttttagaggtcgaggagggtagattatttgaggttaggagttcgagattagtttgattaatatgatgaaatttcgtttttattaaaaatataaaaattatttgggaagtcgaggtaggtagattacgaggttaggagttcgagattagtttggttaatatggtgaaattttgtttttattaaaaatataaaaattagttgggcgtagtgggatgcgtttgtagttttagttatttaggaggttgagataggagaattgtttgatttttggaggtagaggttgtagtgagtcgagatcgtgttattgtattttagtttgggtaataagagggaaattttattttaaaaaaaaaaaaaagaaaagaaaagagagagagagaacgtgttagtgttgtgtgattttgggataattattttttttttttgggttttggttttttaagtttttaatgataggattaaatagatggattcggaaggtttttatagtatatggttttttggaatgttgtaggaaatagttattaattaagtatttttattcgggttttatttttattttagtggagttatgaagttaaagtggggagggggttgggttttattttggtatttgtatcgataggtattcggaattgggggagagatttaatttgtatttttatatttatattaggattttttttataggtttgtgttatttatttttataaagttgggtagttttttgtgtagaagtttttttattttttttttatttagtttgaatttgtcgtttttttggtaggagtatttgtggaaggtagtgattagtatagttagcgtttgttttagagaattgtatattatggatttgtggttgtagaggtgttaggtgatgggtatattgttgaggtttttggggttttagtttagtttgtaggatttatttttgttttatgtttttaagttattttataaaatttttttttgaatgggaaggtaggggttgtattttttttttagattgtggttttttgaggtcggaggcgatatttttattttattttgagggtagacgttaaagttttttttgtgtttgggagttattaagttttttttgatggtatttgggatatttttttgagggtagggttttttattttagtgtttgttagaagggaaatgatagggtgattagagttttattttgatggtatttgcgtaggttttggggagtagggttatatgtatcggttggtagatgggggtttttgtgtagtttggtaggagttatggttatagtttaggagtaggaagttttttgaaggagtcgtttttttttttagattcgggatttttgaagttagaggtatttttttttgttatttaattggaagtttttttgggtaggagtgtttttttttttagattaggagtttttagagggtggggaatgtgtttttttttattttgaaggtttttgagtttttaggtagataggggtatggatagggtgggggtaatttaatattttttttattaggaaggattttgttggaattagaattaaagatatgaaatgtttattgttttgggattaggatgggatagattttagcggtaaggtttttgagaatatttagattagtttggaaaggttaggtaggttttagggtgaggttagaggagttatgttagaggtagggtatgttttgggtttattatgttagttttgtttttatcgaggtagggggtagagttttgttgtttggggttatgatttaggtagagttttgagatttttgttttttgtattttagttttgttagaatttaggattttgtaaaaaaaaaaaaaaaaaaaaaaaaaaattttaggattttttttgtagtaacgtttatatgtatattttttgtttttaggtttagatttttaaagaagggtttttagattgagatatttaggggagggttttagagtaatttttgtattgagattttatagaggaatttggagaaaaattttttagtcggtcgggcgcggtggtttatttttgtaattttagtattttgggaggtcgagatgggtggattacgagattaggagatcgagattattttggttaatatggtgaaattttatttttattaaaaatataaaaaaattagtcgggtatggtggtgggcgtttgtagttttagttattcgggaggttgaggtaggagaatggcgtgaatttgggagggggagtttgtagtgagttgagattatattattgtattttagtttgggcgatagagcgagattttattttaaaaaaaaaaaaaaaaaaaaaaaattttttagttaatattttagtattttatagagagtttttttaagggggaaggtttagagaggtttaggttgattttattagggaagttggaatgagagaattgtggagataaagatagagatttacggggattttttttattttgtttttagtaggatagaggtatttattagattaggtggtagagatagatttaggaaggagagtaaggtagttaggtttttagggtgaggatttatatgtgggttttattggtttttaatttggtattttaaggaaattaaatttgttttaatttgattttattaaattttggttttttgttatttttatttatttttttttagtttttttttttttagagagtgttagttttattattagttgggggagggttttaggttaggttaagggtagtttttgagtttatttaggttatagtgggaagtgggaggtgtcgtggggattgggtattttggatcggggtgaggggaggtaatttttgttttggggtttggagattggtgttaggttttatttttatgatatgtttgtgagttatagtttatttttgtgtgagaggttgtgagtatacgttgagattttatggtttagtgttcgtgtatatatatgcgtttgtgtgtgtgagagagaagtaatttggggttatttttaggaagttgggggttagaggaggtagttgggggatattaggaggagaaggataggattgattttagggtatggatgaagtggagtgatttttaatggttagtattagaatattttttaatgaggtaatgaggtaattaagtgtgtttagaaatatttgggaaggtttttttgtgtaggaaggtgtttggaaggatggggaagtagtgagaaatggggttgttttatatatagtcgtagttgggttgggttatagtttgtggggagtataaggaagttttaagtagttaaaggttgaataggaaaattttggtttttttttttttagtttgagggttgggtgggtgggtaggggtatatttttatttaaggttgaaaatattagttggatagttttttaagttagaatttaggtttgaagtatagtttttagttatagtttttttttattgttttttatatatatgttttttttagattcggagaaaggtaaatattgtggttatttagagtttagtttaagggagggttgtttttttttagggtttttttttttttggttttttgtttatttcggttcgtttgggtattagggtatcgttttttttgtggttttagtttttttttttgttttagttgtcgagtagttttttttttttttttagtttttttattttagttttaagtgatttattcgaggttttaggtttagatgtttaggtagtgatttagcggtatattttttttttttagggttagggtagtagtagttttagagtagtaggtggaagttttagtttagtttggtagggaaagtattggtatagagattttaaataggttttgttaggaggagttttggataatgatatggtaggaggattagattgagaataggttggtttttttttagcggttatcgtgtgatttgggggttagtttgagtagtgtatatgaagttaggttttggggtttttagtgtttttttttatattttggtatagttatcgagtgttttttgttttttttagtatttgaattttttatgttatttgtttttttatcgaggtttattttaagtagaattcggaataaaaattttttatattgagggtgagggataagggagcgtaatgtatcgatttttatagttattttttttttttaattaagggtttttatagggttttttttgtttagaaattgtagtgtatttttatggttgttttttaaagttaggcggtatgtttttatttataagtgggagttgaataatgagaatatatggatatagggaagggaatattatatattagggtttgtgggtagttgcggggagaaggatgggggtaaggggagggagagtattaggattaatatttgatgtatgcggggtttaaaatttagatgatgggttgataggtgtagtaaattattatggtatatgtatatttatgtaataaattatattttgtatatgtatgttagaatttaaagtaaaaataaaataaaattaaattaaaattaaaaatttttaaaaagtttggtagtgaggcgttttagattcggtttgttgttgcgtgttttttaaatatatcggtatatgtaattagtgtggttaagattttcggtttgcgttgatttttttgtttagaacgtgtttatatatgtttatgttttttattttgttgaaatttaattttttttttaaaggttattgtagggagtttttttagggtttaatcggatttagtgtttatttgttttgttttgtataaagcgttttttttgtttttttcgtgtgtatttagagaattttgattttgattgaattatttgtgtatttgtttttttttagttttatttttatatggtgagtttatcggttttatttatttttgtatgaggtaagggtttcgtttatattaggtgttaattagtgtttacggttattatatggtaataggggttattggaggagtgtttaggagtaagggagttttttttatttcgtgaaattatattattgattatgttacgaaataattattttttttttggattttaagagtggaatcgagataacgggtcggaaaagagttttagagagttataaatttttgaggagtgatagtaggaaattgcggtttttaggatttagtgagggagttgagtaaattttttagcgggtagagacggagataggtaggtagacgaagaagataaagagttagttagatggaaaagttagggagaaaaatagagatagtagtagagtcgcgggttattagggttagtttttgaaggtttgtttttaattaggtgtttttgttttaggaattgaggttgcgattgcgtttattaaatggttatatatttgagattggtgataatcgtatttatttgttattaatttgttgcgtaattttgggtaatttttttttttacggtagggtaggagagttgtacggaatggtttttagagttcgattttaattttatttttatattttttagttgtttataaaggtagagtagttaagatataagtaggttttgcggatatttaaagtagtgattttgtttcggtttagttttaggaagttgggtttttatatttcgtttattttattttcgggttttaggtgttagaaattttttattagcggtttcgcgggattttgtttagttgtttcgtgttttttggtggttaaggcgtgttattgtagtgtcggttttttgttatttttttttttttgttcgttagattttttggcgttttgtttacgatttaaataggagatagtgttgatttatttttaagcggtttttttatatttatatttgttttatatagatgaggtttttcggatagtttttgtttagaagtttaggtggatgtttgagacggtagttagatatttggaagttattttaaaagtttagggatatgggtattcgggagataggaggcggaaagattatttgagtttaggagtttgaggttgtagtgagttatgatcgtgttattgtattttagtttggacgatagagtaagattttgttttaattaattaattaatgtaagtttagagataagggtaggagaaaattaggggatagaagtgagggattggttattgttaagttttgtttatttattttttttttttaggtcgtttaggggaaagagaaatggttttattgtgggggttataggtttagtttaagttttgatattgtttttggtttattgtgtgattgtcgattttggttgagtggtgttacgaatttgagtttaaacgtttttagtagaaggattttttttattatgtttcgttttataaaataagttttgaggtattttgttttagtaaaatgtattaaataatttattttttttgttgtattaattggatttataagtgtttttcggtagtatgattagtatgcgaggatttacgttattatattgggtttaggttattttggatttgttatttataatgggcgtgtgtatattttttgttggggggtgtagattgaaattttgaagtattcgttgtgcgttaggtgtttttcgtatattattttatttaatttatataataattttaggagttggaataagatgattttattttatagaggagaatattgagatttaaagtttgttaaatttatataattagtaaggggtggggaggtatgacgaatataggtggttataacgttaaattttttttagaagttttaattatttttcgataattttgagagttttaatattttatttttatttagattagttttagtttttttgtttattttttttttattttatatttagtttatttgttttattttttaattttagtaggcgttagaagtttattttttttttatttttgattttggtattttttttttttgtttttaaatgttttgtggattggattttttttaatttttgtttatttatttatttgagatatagatttattgtcgttaaggttggagtatagtggtattattatagtttattgtagttttatgtgatttttttatattaatttttttagtaattggggttataggtgtgcgttattgtgcgtatttttttgtattttttgtggtgatggagttttgttattttgtttagacgggttttgaatttttgagtttaagtaatttttttgtttcggttttttaaagtgttgggatattaacgtgagttattatgtttagtttagttcggattaaatataaatataaaagagattgggtatggtggtttatatttgtaattttagtattttgggaggttgaggtaggtagattatttgaagttaagagtttaagattagtttgtttaatatggtaaaattttatttttattaaaaatataaaaattagttaggcgtggtggtataagtttgtagttttagttatttagggaggttgagttaggaaaatcgtttgaatttgggaggtagaggttgtagtgattcgagattatgttattgtattttagtttgggtgaaagagtaagatttttttttaaaaataaattaaaaatgaatatgttatttaatttaatatttttattgttaaatatttattttatgttgttatttttttattagtatgtaggtatataaatagatatttgtaagaaggaagaaatggatataagaaaaatttttattaataaaggattgggttgggtatagtggtttatgtttgtaattttaatattttgggaggttagggtaggaggattatttaagtttaggagtttaagattagtatgggtaatataatga

SEQ ID NO: 227 - DNA, 10001 bp, Artificial Sequence
  chemically treated genomic DNA (Homo sapiens)
ttattatattgtttatgttggttttgaatttttaggtttaagtgatttttttgttttggttttttaaagtgttgggattataggtatgagttattatgtttagtttaattttttattgatggaaattttttttatgtttatttttttttttttgtaaatatttgtttgtatatttatatattggtggaaaaataataatataaggtaaatgtttggtagtagaaatattaggttaagtggtatgtttatttttaatttgtttttgagaaaggattttgtttttttatttaggttggagtgtagtggtatgatttcgggttattgtaatttttgttttttaggtttaagcgatttttttggtttagtttttttgagtagttgggattataggtttgtgttattacgtttggttaatttttgtatttttagtagagatggggttttgttatgttaggtaggttggttttgaatttttggttttaggtgatttgtttgttttagttttttaaaatgttgggattataggtgtgagttattatgtttagttttttttatatttatatttaattcgggttaggttgggtatggtggtttacgttggtattttagtattttgggaggtcgaggtaggaggattgtttgagtttaagagtttaagattcgtttgggtaagatggtaaaattttattattataaaagatgtaaaaagatgcgtatagtggcgtatatttatagttttagttattgaggaggttaatgtgggaggattatatgaggttgtagtgagttgtgatggtgttattgtattttagttttggcgatagtgagtttatgttttaaataagtaagtaaataaaaattaaaaagaatttagtttatagggtatttgaaggtaagaggaaaagatgttagaattagagatggggagaagatgggtttttggcgtttgttgaggttgagaaatgagatagataggttgagtgtggggtggagagaggatgggtagagagattgaggttggtttgaatggaaatgaaatgttagggtttttagggttatcggggaataattggagtttttaggaaaggtttaacgttgtgattatttgtgttcgttatgtttttttattttttattaattgtgtgaatttggtagattttgagttttagtgtttttttttgtgaagtggggttattttattttaatttttgggattgttgtgtgaattaaatggggtaatgtacggagagtatttgacgtatagcgagtgttttaaaattttagtttgtattttttagtaaaggatatgtatacgtttattgtgagtgataaatttaggatgatttgaatttaatgtgataacgtgggttttcgtatgttggttatgttgtcgggagatatttatggatttaattagtataataggggaaataaattatttaatgtattttgttaagatagaatattttagaatttattttgtggggcggggtataataaagggggtttttttgttgaaaacgtttaagtttaggttcgtggtattatttaattaaggtcgatagttatatagtaagttagaggtaatgttaggatttaaattaaatttgtggtttttataatgaggttattttttttttttttgaacggtttggggaaagggggtgggtgggtagaatttggtagtggttaattttttatttttgttttttggtttttttttgtttttatttttaggtttgtattgattgattgattgagatagggttttgttttgtcgtttaggttggagtgtagtggtacgattatggtttattgtagttttaaatttttaggtttaagtggttttttcgttttttatttttcgagtatttatatttttaggtttttaaaatggtttttaggtatttggttgtcgttttagatatttatttgggtttttgggtagggattgttcgggaaattttatttatgtgaagtaggtgtgggtgtaggaaggtcgtttggaaatgaattagtattgttttttgtttgagtcgtaagtagggcgttagagggtttggcggataagaaagggaggatgataggaggtcggtattgtaatgatacgttttagttattagagggtacgaagtagttgggtaaaatttcgcggggtcgttggtggaaaatttttggtatttggagttcggagatggggtggacggaatgtgaggatttagttttttgaggttgggtcggggtagagttattgttttggatgttcgtagggtttgtttgtgttttgattattttgtttttgtagatagttggagaatgtgagagtgggattgggatcggattttaggggttatttcgtataatttttttgttttgtcgtgggggagggagttgtttaaggttacgtagtaagttagtggtaaatgaatacgattattattagttttaggtatatggttatttgatgggcgtagtcgtagttttagtttttgagatagagatatttgattaaggataggtttttaggagttgattttagtgattcgcggttttgttgttgtttttgtttttttttttggtttttttatttgattgattttttgtttttttcgtttgtttgtttgttttcgtttttgttcgttggggggtttgtttaatttttttattgggttttgggagtcgtagttttttgttgttattttttagggatttgtagttttttgaagttttttttcgattcgttgtttcggttttatttttgggatttagaggagaggtgattatttcgtagtatagttagtggtgtgattttacggggtgagaaggatttttttgtttttaagtatttttttagtgatttttgttgttatgtggtagtcgtaagtattggttggtatttggtgtgggcgagatttttattttatgtagaaatgagtaagatcggtgagtttattatgtgggggtgaggttgagagaaaataagtatataggtgatttagttaaaattagaattttttaagtatatacgaaaagggtaaaaggggcgttttgtataggatagaataggtagatattgaattcggttgggttttgggaaggttttttgtagtggtttttgaagggggggttggattttagtaggatagagggtatgggtatgtgtgggtacgttttgaatagaggggttagcgtaagtcgagggttttggttatattagttgtatgtgtcggtgtgtttaagggatacgtagtagtaggtcgagtttggagcgttttattgttaggttttttaaaaatttttaattttaatttaattttattttatttttattttaagttttggtatatatgtgtagaatgtggtttgttatataggtatatatgtgttatggtggtttgttgtatttattaatttattatttaggttttaagtttcgtatgtattaggtattagttttaatgttttttttttttttgtttttattttttttttcgtaattgtttataggttttggtatgtggtgtttttttttttgtgtttatatgtttttattgtttaatttttatttatgagtgagaatatatcgtttggttttaagggatagttatggggatgtattgtagtttttgagtagggaaggttttgtggaggtttttagttaaaaggaaagaatggttgtgaaaatcgatgtattgcgtttttttgttttttatttttagtgtgaagggtttttatttcgagttttatttgaagtaggtttcgatgggaagataagtagtatgaggggtttaagtattgaggggagtaagggatattcggtggttgtgttaaggtgtagaagaggatattgggggttttaaggtttgattttatgtatattgtttaggttggtttttaagttatacggtgatcgttaggaagggattagtttgtttttagtttgatttttttgttatgttattatttaaagttttttttggtagggtttgtttggggtttttgtgttagtgttttttttgttaggttgggttggggtttttatttattgttttgggattgttgttgttttggttttgggggaggagggtgtgtcgttgagttattgtttgggtatttgggtttggaatttcgggtgagttatttagggttgaggtagaggggttgggggaggggaagaagttattcgatagttggagtagggaggggagttggggttataggaagggcggtgttttgatgtttagacgggtcgggatagataaagggttaaggaggaaggggttttgggagggggtagtttttttttgggttgggttttgaatggttatagtgtttgttttttttcgggtttggggaggatatgtgtgtggggggtagtgagagagggttgtggttgagggttgtgttttaggtttggattttggtttgggaagttgtttagttggtgtttttagttttgggtagggatgtatttttatttatttatttagtttttaagttggagaagaggaggttaaagtttttttgtttagtttttaattatttgggatttttttatgttttttatagattgtggtttagtttaattgcggttgtgtgtagagtaattttattttttattgtttttttatttttttagatatttttttatatagagggatttttttaggtatttttaagtatatttagttattttattattttattaagaggtattttggtgttggttattaaaagttattttattttatttatgttttgaagttagttttgtttttttttttttgatgttttttagttgttttttttggtttttagttttttaagggtggttttaggttgttttttttttatatatataggcgtatgtatgtatacgagtattggattatgaagttttagcgtgtgtttatagttttttatataggagtgggttgtgatttataggtatgttatgagaatgaggtttggtattagtttttaggttttagagtaggggttgtttttttttatttcggtttaggatgtttagtttttacgatattttttattttttattgtggtttgggtgggtttaggggttgtttttgatttggtttagagtttttttttagttggtggtggagttggtattttttgggagggagggggttgggagggaatgagtgggaatggtaagaggttagggtttggtgggattaggttgaggtaggtttggtttttttaaaatgttaagttgggggttagtggggtttatatataaatttttattttgggagtttggttgttttgtttttttttttgggtttgtttttgttatttggtttggtgagtatttttgttttgttgagggtagggtggggaggattttcgtgggtttttgtttttgtttttatagtttttttattttagtttttttggtgggattaatttgggtttttttgggtttttttttttggaagaattttttgtgaagtgttgaagtgttgattgaagggttttttttttttttttttttttttgagatggagtttcgttttgtcgtttaggttggagtatagtggtgtgattttagtttattgtaaatttttttttttaggtttacgttatttttttgttttagtttttcgagtagttgggattgtaggcgtttattattatgttcggttaatttttttgtatttttagtagagatggggttttattatgttagttaggatggtttcgattttttgatttcgtgatttatttatttcggttttttaaagtgttgggattataggagtaagttatcgcgttcggtcgattgaagggtttttttttaggtttttttgtgaggttttagtgtaggggttgttttgaggtttttttttggatattttagtttaggggtttttttttgggggtttaggtttaggagtaggaggtgtgtatgtgggcgttgttgtaaaaagaattttgagatttttttttttttttttttttttttttgtaaagttttggattttagtaggattaaggtgtaagaggtaggggttttaagattttgtttgggttatggttttaagtagtaaagttttgttttttgtttcggtgaaggtagggttggtatgatgggtttagggtatgttttgtttttggtatagtttttttggttttattttgaaatttgtttaatttttttaggttggtttgagtatttttagaggttttgtcgttgaggtttgttttattttgattttaaggtaatgaatattttatatttttaattttaattttaataggattttttttggtggagagaatgttaagttgtttttattttatttatgtttttgtttgtttagaggtttaggggtttttagggtgaggggagatatattttttattttttgggagtttttagtttgagagaggaaatatttttgtttaagggagtttttagttagatggtagagagagatgtttttggttttaggagtttcgagtttaaggagggaaacgatttttttagggagttttttgtttttaggttgtagttatggtttttgttagattgtataggagtttttatttgttagtcggtgtatgtggttttgttttttagagtttgcgtagatgttattaaaatgggattttggttattttgttattttttttttggtagatattaaaatggggagttttgtttttaggggggtgttttaagtgttattagaggaggtttggtgatttttagatataagggaagttttagcgtttgtttttagggtgagatggaggtatcgttttcggttttagggaattatagtttgagggggagatgtagtttttgtttttttatttagagaggggttttgtgaggtggtttgggggtatagggtagaagtggattttataggttgagttaaggttttaagagttttagtagtgtatttattatttggtatttttgtagttatagatttatgatgtgtagttttttggagtaggcgttggttgtgttggttattattttttataagtatttttgttaagagggcgataagtttaagttgagtaagggggaaatgaaggaatttttgtataaggagttgtttagttttgtgggggtgagtggtataggtttgtgggggaggttttggtgtgagtgtgggggtgtaggttaaattttttttttagtttcgggtgtttgtcgatgtaggtgttagggtggggtttagttttttttttattttagttttatggttttattggagtggaaatgaggttcgagtgggagtgtttaattaatggttgttttttgtagtattttagagaattatgtgttgtgagggtttttcgagtttatttgtttaattttgttattggagatttgagaaattagagtttagaagggaaaagtgattgttttaagattatatagtattggtacgtttttttttttttttttttttttttttttttttttttgagatggagttttttttttgttgtttaggttggagtgtaatggtacgatttcggtttattgtaatttttgtttttaggggttaagtaatttttttgttttagttttttgagtagttgggattataggcgtattttattacgtttagttaatttttgtatttttagtagagatagggttttattatattggttaggttggtttcgaatttttgatttcgtgatttatttgtttcggttttttaagtgatttttgtatttttagtagagacggggttttattatattggttaggttggtttcgaatttttgattttaggtgatttgtttttttcggtttttgaaagtgttgggtttataggcgtgagttatcgtgttcggattttttttttttttttttttttttgtggtggggggataagattttattttgttatttaggttggattatagtttattgtaatttcgaatttttgggtttaagtaatttttttaagtagttggaattataggagtattgttattatgtttggttaatttttatttttgtagagatggagttttgttatgttgtttaggttgggtttgaatttttgggtttaagtaatttttttatttcggttttttaaagtattggaattatagatgtgaggtattgtgtttgatttttttttatttttatatgttaaattaagaaagtatgtagggatagaaaagtttagttaagatatatagtttgggatattttgtggagaaatgtatcgatttttaatttgttttttattttttttatattgatttattggtgatttttaaagttaggtgttaggttttgaatatatgaggtaggttttttttttttttttttaattttgtttttgtggttggttaaatttttttaattatttcggttagtattaaaaaagtgttttttagttgggtgtagtggtttatgtttgtaatttttatagtgtgggaggttaaggtaggaggattttttaagtttaggagttcgattagtttgggtaatatagtaagattttatttttataaaaataaaaataaaaattggttaggtatggtggtatacgtttgtagttttagttatttgggtggattgtttgagtttaggagtttaaggttatagtgagttataatatagtttgggtgataaagtgagattattttggttgttaagattagtttaggtaatatagcgaggttttgtttttattaaaaataaataattagttgggtgtggtggtatgagtttgtggttttagttatttgggaggttgaggtgggaggattgttggagtttaggaggttgaggttgtagtgagttgtgattgtgttattgtattttagtttgggtaatagagtaagattttgttttaaaaaataaaaagtgtttttttttgaatttatttggttggtgttggggagtagtaattttcggtttttttattagtagaatggggtgatgatatttatttcgttgggtttttgtgggattcgagttgatgtatgtttagaggagtatttagtgttttttttgtgtttaggaggagggtatattggagatgtttattaatgagtatttgtttttttttttatttattgggtttttttggtagtttttagggttttttgtttattttatatttagttgtttagtggggagggagagttgggaattaatttgaatgtgtgagggtttgggtgtttggtggagttggggttggggttggtttggtgatgagtgtattttttgttatttttaggagaaagtggatgaggaggggttgaagaagttgatgggtagtttggatgagaatagtgattagtaggtggatttttaggagtatgttgtttttttggtatttattattgttatgtgtaatgattttttttagggttgtttagatcgattttgaagtagaatttttgattttttgttatggattttttgggtttaggattgttgatgtttttgagttttgtatttaataaattttttttgtttgttgataatattttaattgtttagtgatgttttataattcggttggtttagttggagtgttgggagatgagggttttttggattttgtttttttttgggttttgatttttttggaaatttttttaaggttagagttatgttttaggttttaattttggaattttaaatattagtaaaaaattggaaatcgagataggttgttgatttttattttgttaaataaagatattaaaaaaggtaaatattatttattattattattattttataaaaagataaaattttaattttaataaaggaggaaaggtataattttagaataaaggatagattttaatatttaatattgtaagtaatgagttgtattaggatttatttaagagatatgaattagtttaatcgatttcgtaaagttttatttaaaagattttttgttagatcgagtacggtggtttatatttgtaattttagtacgttgggaggttaaggtaggtagattttttga

SEQ ID NO: 228 - DNA, 4449 bp, Artificial Sequence
  chemically treated genomic DNA (Homo sapiens)
ttttttgtatatttgagaggtaagaggaggtgtttgtggtttttttgatatatacgtgatatatgtattattacggtttatgtgtgtgttgttgtgtgtagggggtagggggtttttcgtttttgatggttttttttggtgggtgtttttcggttttttaggtttttttatttgttgaacgtggtagttaagggtttgggaatgatttgttagattggttaatgtggaaagagttggtttcgtttagttttgtatttttttttttttttttggaatcgtttggttgtagagagtaggagttttttagagttttcgggggattttatttttagtataattgtgtaacgtgtgtttagtataagagtattagatggagggataggtgggaggaggaggaatttagggtgtatttagtttggggtttgttgagttgaggtttttagagtaaggacgattaggttggggggatatttttttttaatttttgttaagttatagaggggttagtgggaataaagtgatattttggtttttgtattttttttttgttgttttattttttagttcgtttagatttgaggttggggaggggtttttttggaggggttagtttatgttattttttgtaatttttattatatatgtttttagatattttgttataggttttattttttacgttaatttttatttgggaaagtaaataaacggaaagttaatttgtgttatttggtcgttggggtattcgtagtgagtagttaagaaatgttaggggagtcggtgtttatttttatgtttggataagagtgcgttttggatttgcgttttgttgtatattttatcgtttcgttgtatattttatcgttttattgtatattttattgttttattgtatattttatcgttttattgtatattttattgttttattgtatattttattgttttattgtatattttattatttttgttttttgtatttagttgtttatttgtattttagtttaggaagtttagaagatgtagaatttttgcgagagtttagggtgaaacgttgcgttttatttttaaagaaaggaaaattatttatattttttaaaagaatgaatagtatagattaatatcgattttttttaatttttaggttaattttgagtagttaaagttagagtagttaatttgtgttgtgagtcgaggtatagttgtagaagcgtgtttgaggtgttcggtggaggtggtagtcgagttttgggattaattatcgtgttggggacggtatcgcgttaggatgtaggtagatttttgtagaagtgtttaaaatttatatttttttataggggtgagggggagggagaaagagatgttttagtgaggataaatatttttttttatatttaaataattatagagtttttattttaaagtatttataggtatattttttagaaaatatgaattgttagtcgggtacggtggtttacgtttgtaattttagttttttgggaggttgaggcgggtagattatttgaggttaagagtttaagatcggtttggttaatatggtgaaatttcgtttatattaaaaatataaaaaaaatttagttgggcgtagtggtatatatttgtaattttagttattaggaagttgaggttgaatttaggaggtagagattgtagtgagttaagatcgtattattgtattttagtttaggggtaacggagcgagattttattttaaaaaaaaaaaaaaaaaaagaatatatgaaatgtttttagatttcgttatgttttttttttttattttaggtaagttagaaagcgttattaatagtggttttttttaggtttttggttagagatgtgaagagaagtcggggggaaattaggtttttttttaagttttttagttttgtttttttatttttggatttgaatgtagtttgatttaggttattttattgtattattattggcggtcgtgattttgtgtaaaggtatagttggtgatgttgattagagtttttgtagttttaaatgatttttttaattaattttaaatttttagaatttatcgtataaaaaggttatattttttggagggacgtcgatggtattaggatagaagtattaggggattttacgaacggtgtcgtcgaaatagtagtttttatttgtatattgggagggcgtgatattaggaaaattataattttgttttttacggggggttattgtatacgtttttgaaagtgtataggtaagaagtaaagtaagttgtgggttgaattttttgatgttattatgtatatatttatttagtttttttttttaatgatattagtaattgtttagtgaggcggatataaaatttttaggatatgagagggagacgtggtttttatattttgatgtgtaaatattacgtttagggaaaatgtaaggtgttttaggtttgtggattttgtatttttttaggtaatttatttatttattttttaattttaataaatgattattaaattttatttaatatataaatatttattgagtattatttgtgtgtatgagaagtgggagttagtatggtaaaagttaggtattgtgttaggtgagagagatttagaaattaaaattagagaagttattaataagagtttaaatatttgggtttaggtttatgtttgtaattttagtattttgggaggttgaaggaggtgaattatttgaggttaggagtttaagattagtttgattaaaatggtgaagttttatttttattaaaaatataaaaaattaggcgggtattgtggtatacgtttgtaattttagttatttgggaggttgaggtaggagaattatttgaatttaggaggtagaggttgtagtgagttaagatcgtattattgtattttagtttgagtgatagagtaagattttattttaaaaaaaaaaaaaaaagagtttaaggatttgatggaggagaaaggtaagaatatgtgcgagataacgtaaggttatcgttttagggtgtttagggtaattacgggggtagggtatttttcggagaggttaatgataagtaggttgaataaagtaggggggttttttgtaggaggaggtttattaggtgaagatggagtcgtatgggtaaaggttattttagagatttaggtgtgtttaggaggtggaaatttattgtaggtaaggtgagaggatcgggtggggtggtttaggaggagtcgatagagggtataagttgtgaaatagtttgaagtagggtagtgaggaaagggatttagaggaggaagatacgtggatagatggggttggttgggggttgtcgtaggattttatgtaagaggttttaatattagagttttaggttttgagtttcgcggaattaaaggttttagaaagtaatttattaggatttggtggttgatagtttgtagtagggggtgaaagaggagtttagagtatttttcggtttttgtttttgttttggggtataggaggggaggaatttagtttggttatattggtttaggtgagggcgttttaggggaggtcgagaggggttgtttttttgtttgttttgttattagggattgtttcgagatgtttttggagaaagtgtttttggtttgttgggaaggattcgtgtttagttttcgttgtttagtagtttttatgggaattttgtttttttggggtttggatttatcgcgacgtgaaggtgattatcgtttattttcgggatattgtgggggttaagagaggtttcgtggtgagggaggattattattttgggggtcgggggggttttttttttagggaggaagatttttagtttcggtgttttgttttcggtagattttgttttgtttattcgttttgtttttgtcgtatgatggaaataaatggaaatggtttttatatacgaatgtattaaattgtaattataattttttagattttagttgtaataggattatggatttgagtgattcgtaaagacgttttgagttttgagttagagggtgtgtggggtggggaggggagtttgttacggtttttgtgattttatagtatagggggtagagttgggggttggggtgggggtaagggcgtaggtagatgggtttgggggtggttagtacggggatttatttagttcgttttgtatatcgaggttattttttttttcgggttttaaagttttttcgttttttgttatgggtttgggggtttttttattgtagtttaatgttggttgtttttttacgttgtttaagtttattttttaggttcggtattttatagtagagattaagaggtggttggagggtagtgggggtacggatagtattattgggcgttttttttttaggtttttttggaaatttttgttttggaaacgtagaaagtttttttttttgtttttatttt

SEQ ID NO: 229 - DNA, 4449 bp, Artificial Sequence
  chemically treated genomic DNA (Homo sapiens)
aaggtgggggtaggagaaagggttttttacgtttttaaagtaagggtttttagagaggtttgaagagggagcgtttagtggtgttgttcgtgtttttattgttttttagttattttttgatttttgttgtggggtatcgggtttgaggggtgggtttgggtagcgtagaagagtagttagtattgggttgtagtgggaagatttttaagtttatggtagggagcgggggagttttggaattcgagagaggaagtggtttcggtgtatagaacgaattgggtgggttttcgtgttggttatttttaggtttatttgtttgcgtttttgtttttattttagtttttagttttgttttttgtgttgtgggattatagaggtcgtggtaaatttttttttttattttatatattttttggtttaaggtttagagcgtttttgcgggttatttaggtttatgattttgttataattgaaatttagaaaattgtgattatagtttagtgtattcgtgtgtggaaattatttttatttatttttattatgcgataaagataaagcgggtgggtaagatagagtttgtcggaggtagagtatcggggttggaaatttttttttttgaggaggaaattttttcgatttttaggatgatgatttttttttattacggggttttttttgatttttatagtgtttcgggggtgggcgatgattatttttacgtcgcgatggatttagattttaggagggtaaggtttttatggaagttgttgggtagcgggagttgaatacggattttttttagtaagttaggaatattttttttaaagatatttcgaggtagtttttgatagtaaagtagataagagaatagtttttttcggttttttttggggcgtttttatttgagttagtgtggttagattgagtttttttttttttatgttttaaggtagggatagggatcggagggtgttttgggttttttttttattttttgttgtaggttgttaattattagattttaataggttgttttttgagatttttgatttcgcggagtttagagtttgaagttttggtgttagaattttttgtataagattttgcggtagtttttagttagttttatttgtttacgtgttttttttttttagatttttttttttattgttttgttttaagttgttttatagtttgtattttttgtcggttttttttagattattttattcggtttttttattttatttgtaatgggtttttattttttgaatatatttgggtttttggaatggtttttgtttatgcggttttatttttatttggtgaatttttttttgtagggagtttttttgttttgtttaatttgtttgttattggttttttcggggagtgttttattttcgtggttattttgggtattttgggacgatggttttgcgttgtttcgtatatgtttttgttttttttttttattagatttttagatttttttttttttttttttgagatggagttttgttttgttatttaggttggagtgtaatggtgcgattttggtttattataatttttgttttttgggtttaagtgatttttttgttttagttttttaagtagttgggattatagacgtgtgttataatgttcgtttaattttttgtatttttagtagagatggggttttattattttggttaggttggttttgaatttttgattttaagtgatttattttttttagttttttaaagtgttgggattataggtatgagtttgggtttagatatttagatttttattaatgatttttttggttttaatttttgggttttttttatttggtatagtgtttggtttttgttatgttagtttttattttttatgtatataaatggtgtttagtaaatatttatgtattgagtaaaatttaataattatttgttgaaattaaaaagtgaataaataagttatttagaaagatgtaaagtttataaatttggggtattttgtattttttttgagcgtaatgtttgtatattaggatgtgaggattacgttttttttttatgttttgagggttttatattcgttttattggatagttgttgatgttattggagaaggaagttggatgggtgtgtgtatgataatattaaggaatttagtttataatttattttgttttttatttgtgtatttttagagacgtgtatagtggtttttcgtgaaagatagaattgtggtttttttggtgttacgtttttttagtgtgtaaataagggttgttgtttcgacgatatcgttcgtggggttttttggtgtttttattttaatattatcgacgtttttttagaaggtatggtttttttatacgatgggttttgaagatttagaattagttagaaaagttatttaagattatagaggttttgattagtattattagttatgtttttatatagagttacggtcgttagtggtggtgtaatggggtagtttgagttaggttgtatttaggtttaggaatagaaaggtagggttaagggatttgggaagaaatttgattttttttcggtttttttttatatttttaattaaaagtttgggaagagttattgttggtaacgttttttagtttgtttaggatagagggggaaggtatgacgaaatttgaagatattttatgtattttttttttttttttttttttgaaatggagtttcgtttcgttgtttttgagttggagtgtaatggtgcgattttggtttattgtaatttttgttttttgagtttaattttagttttttagtagttgagattataggtgtgtgttattacgtttagttaaattttttttgtatttttagtatagacggggttttattatgttggttagatcggttttgaatttttgattttaggtgatttgttcgttttagttttttagagagttgggattataggcgtgagttatcgtgttcggttgatagtttatgttttttaaagaatgtgtttatggatattttaaagtaaaaattttgtaattgtttaaatgtgaaagaaaatgtttatttttattaaagtattttttttttttttttttttatttttgtagaggagtgtgaattttagatatttttgtagggatttgtttgtattttgacgcggtgtcgtttttagtacggtgattagttttagagttcggttgttatttttatcggatattttagatacgtttttgtagttgtgtttcggtttataatatagattgattgttttgattttgattatttaaaattggtttaaaaattaaaagagatcgatattaatttgtgttgtttatttttttaaagaatatgaatgatttttttttttttgaaagtgaagcgtagcgttttattttgggttttcgtagaggttttgtattttttgggttttttgagttgggatataagtgggtagttgagtgtagaaagtagggatggtggggtgtatagtaggatagtggggtgtgtagtaggatagtggggtgtgtagtaggacggtggggtgtatagtaggatagtggggtgtgtagtaggacggtggggtgtgtagcgggacggtggggtgtgtagtaggacgtaagtttaagacgtatttttgtttaggtatgaaaatggatatcgatttttttggtattttttaattatttattgcggatgttttagcgattaagtgatataagttagtttttcgtttatttgtttttttaaatagaaattggcgtaggagatgaaatttgtagtagaatgtttgaaagtatgtgtaataaaaattgtagagggtggtatggattgatttttttaggaaaatttttttttaattttagatttgaacgaattagaaaatagaatagtagaggagggatatagaagttaaaatgttattttatttttattggtttttttgtagtttggtaaggattgggagagggtgtttttttaatttagtcgtttttgttttggggattttagtttagtaagttttaagttaaatgtattttgggttttttttttttttatttgtttttttatttggtgtttttgtgttgggtatacgttgtatagttatattggagatgggatttttcgggagttttggaaagtttttgttttttgtagttagacggttttagggaggaagagggaggtgtagaattgagcggggttagttttttttatattaattagtttggtaaattatttttaaatttttggttattacgtttagtagataaagaggtttgagaggtcgggagatatttattaagaagaattattaggaacgggaagttttttgttttttgtatatagtagtatatatatgagtcgtaataatatatatgttacgtatgtgttaggggggttatagatatttttttttattttttagatgtgtaaggaa

SEQ ID NO: 230 - DNA, 4296 bp, Artificial Sequence
  chemically treated genomic DNA (Homo sapiens)
agaaatttatatatttttttatttttaagaaaaggaagtagtggtgatattattttcggttaaaatgtagtttgtttatattttaaatattcggtaataatgttttttttagagttatgaagtaattagaataattaaatataatttttttttaaatttttattgtttgatttatttatttatttaataaatatttattaaatatcgattatgtgtttgatgtttagggatataatagtaagtggagggaaagatatataatatttgtttttaagaaatttggagttgagtggaggatagaaatataaattaaagaatgatataaataattataaagttatagttgttaaaagaaaagtatatggtgttaagagaacgtgtaatataagatttatttatggaggtgagggaaagtttgtttattaaagaagttatgatttaatttacgaagattaggagttggttgggtgaagaaaaaaaggttagaggaaggaagtttatattggggaaggttttaagtataaagggtaggaggattatagaggtatatttacgaaatttggagaaggtttttagtaagtaaggagaagttaaatgaaagtttacgggagagttggaggtttgaagatacgtttaaggatttggtttttattttttttttattttaagagtagtgggaagttattaaatgattttaattagagggttggtataattagttttgtattttgaaaagttgaatttagttttcgtttgagaaattgagtgaaagagtttagaacggtcgtggttgagggtgattcgtgggagatttttatataagttatggtagtggtatgggttggtggtagaagagggaatagggagaagatttggaatttaatttttttttattgataaagttattttagttttggtaaggtaattaattggtgggaaagaagatgtttagtttttttgattttattgtattttttgtatttttaatatgagtattgggaagtggtaaaatatttagaggtagtttgggtgttaggtggagtatgagttaaaattttaggatgaagtaaatgaatatttagaatgataggaaagatttgggagttgggtttgggggagggttatttatttttattttttggagattttggtataaatttttgtttttgtaattttttttttaggtaaaggaatttattaaatgaattgttagaagatttattgattagagggttgtatagaattatatttttgagagtgggaagtaggttgattatatagtttattatttaattaggatatatttgaaagagaaagggggttttattaatatttaaattataaaatatgtatattaggaatgttttgggtaaatttggttgttttagtaagaaaggaaatttgaaagtttatattgttttgtttttatgttatttcgtttgtatatgagagggtaagtattttttttttttatttgtattaagggaataaaagtataagtatttaggtgatttttaatttatttttaattttatagtttttgttatattttatatattttgaaaattatattttttattattattatttcgtgataggtgattatttataattatttattgatttagtttcgggaagaggcggtgtaaaatgggacgttttatttaggtgtttattagaaatgtagaatttttgtttgttttttagatttattgaattagaatttgtatttttaaataagatttttaggtgattaatatgtatattaaaatttgagaaaaatttttagatttcgatttaaagaaaaatattttataatttgatagtgtatgtatatatatatatgtatatagatataattgaagtataaatttaatgaagtagaatttatcgttattattttatttgggaaagaaatgtgttcgcgatttaatagattggagtatttatttttggattttaatttgtaatttgaaaacgtatttttaaagtatttaggagtaatttgaagaaagttgaggggaggcggtagatgttttgatttattagggaaaacgtggacgttttttgttgttattttgtgaattgtgtgtatttagttatttttgagtaaatatttggagcgaggaatttttgagtggtgtgggagggcggtgaggggtagttgaaagtcggttaaagttttcggaggggttggtttaggaaatatgattggtagttacgagagagttaggggttggacgtcgaggagagggagaaggttttcgggcggagagaggttttgtttagttgttggcgaggagttttttgtttttttcgtagcgttgagttgaagttgagtgagttattcgcgcgtacggagcgacgatattttcgcgcgtgtattcgttcgggataggagtcggatttttgtgtagtttttttcggtcgtcgggggttttttcgcgtttcgtcggtttttaggtttttttttggttggcgagcgggcgttatatttggttcgtatatttgcgttgtcggttcggcgcggggttcggagagggcgcggcgcggaggcgtagttaggggttcgggaaggcgtcgttcgttgcgttgggggttcggtttatgacgagtagcggggtttgttatgggtcgggggttgtttaggggtttgtggtcgttgtatatcgttttgtggacgcgtatcgttagtacgattttatcgtacgtttagaagtcgggtgagtggtttttagttcgggttcggcggggcgtcgggggtttttttggggttttcgttttttcgttgcgtttgatagtcgggttcggtaattcggttttcgggcggaaacgaggaaagtttttttcgcgatatttacgtagttcgattttcgtagttgtagggattgtgagttttttttgaaaaagagaaggaaagtttagttgtaaggggcgcggggtacgtttggttttttttgtgcgagtaggaaaggcgttgtgttggtcgcgttcgaggcgagtttttattttcggaaagggaagtttgagaagttggttatttgaaggcggtcggggagtagcggttcggagcggtagtttgagttgttaaagtagttagcgtatttgggttatttcgtttatggcgatgtcgcgtgtttatttagttttttttgagttattcgtttaaaaggttagttttttagtttttagtttttggagacggttacgtttttttttaggtcggttttttggttcggagtttttggaaataagttttaagaaaataatcgatttttaaaagaaagttagttggttttattgacgttttggtatggatggatagggagtggagatgtttaggtgaaatcgagaattttttattgaatgtttattgggtgttagaggttgtagattttgtttggaataagatagttttgtttttagggagttgatggttttatgtaattatcgtttgttggaaatcgaagggttaaaattttaattaggttatttatttgatcgttgtttttgaaggtttttaaggaaaaaataaaaataaaaaaatatatatatatattatatatatataaatatatatataattatatatataaatatatataatattaatatatatatgtatgtaggaatgggggtttttaattatttgttatggaaagtgtaaaatttttgagattttaaaagttagattttttttttttggagacggagtttcgttttgttattaggttggagtgtagtggcgtaatttcggtttattgtaattttgtttttgggtttaagcgatttttttgttttagtttttcgagtagttgggattataggcgcgtgttattacgtttagttaatttttgtatttttagtagagacggggttttattatattggttagggtggtttcgattttttgatttcgtgattcgtttattttggttttttaaagtgttgggattataggcgtgagttatcgcgttcggttaaaagttagattttttgtagttatgatttaaataatagtatttgtagttgtggtttgggtaatcgagtatttgggtaagttatagagttttttttgggttttagtttttttatttgtaaaatggttagtttgaatttgggtaattttatattatttttatgtttaatattttacgtatcgtgttttttttttttttttttttggtttttttggtgatttggagatgatttatgtagattttggatgaaatgtagaggagttgatagtttatattattcggaggtatttattttatttatttagggatatgggta

SEQ ID NO: 231 - DNA, 4296 bp, Artificial Sequence
  chemically treated genomic DNA (Homo sapiens)
tgtttatgtttttggataaataaaatgagtgttttcgggtgatgtggattgttaatttttttatattttatttaaagtttatatgggttatttttaagttattagaagagttaggggaaaggaggggaggggtacgatacgtaagatgttaaatatgaagatgatgtaaaattatttagatttaagttggttattttatagatgaggaaattaaggtttagaaaaagttttatgatttgtttaaatattcggttatttagattatagttgtagatattgttatttggattatagttgtaaaaagtttaatttttggtcgggcgcggtggtttacgtttgtaattttagtattttgggaggttaaggtgggcggattacgaggttaagagatcgagattattttggttaatatggtgaaatttcgtttttattaaaaatataaaaattagttgggcgtggtggtacgcgtttgtaattttagttattcgggaggttaaggtaggagaatcgtttgaatttagaggtaaagttgtagtgagtcgagattgcgttattgtattttagtttggtgatagagcgagatttcgtttttaaaaaaaaaaaatttaatttttgaagttttagaggttttatattttttataataaatagttaagaatttttatttttgtatgtatatatatattaatattatatatatttatatatataattatatatatatttatatatatataatatatatatatatttttttatttttattttttttttaaaaatttttagagatagcgattaggtgggtagtttagttaggattttaatttttcggtttttaataaacgataattgtatagaattattaattttttgaagataggattattttgttttaggtaaaatttatagtttttagtatttagtaggtatttagtgagggattttcggttttatttgagtatttttattttttatttatttatgttaaggcgttagtggagttagttaatttttttttggaaatcgattatttttttgaaatttgtttttaaaaatttcgggttaagaagtcggtttgagggaaagcgtggtcgtttttaggagttaaggattgaggagttggttttttgaacgggtggtttagaaagagttgggtgggtacgcggtatcgttatgggcggagtggtttaggtgcgttggttgttttggtagtttaggttgtcgtttcgggtcgttgtttttcggtcgtttttagataattaattttttaaattttttttttcgggggtgggggttcgtttcgaacgcggttaatataacgttttttttgttcgtataaaggggattaaacgtgtttcgcgttttttgtaattgaatttttttttttttttttaagaaaaatttataatttttgtagttacgggagtcgggttgcgtgagtgtcgcgggggaaatttttttcgttttcgttcgggggtcgggttgtcgggttcgattgttaagcgtagcggagaggcggggattttaggaagattttcggcgtttcgtcgagttcgggttggggattatttattcgatttttgaacgtgcggtgggatcgtgttggcgatacgcgtttataggacgatgtgtagcggttataggtttttgagtagttttcgatttatggtagatttcgttgttcgttatagatcgagtttttagcgtagcggacggcgttttttcggatttttggttgcgttttcgcgtcgcgtttttttcggatttcgcgtcgggtcggtagcgtagatgtgcgggttagatgtggcgttcgttcgttagttaggagggggtttggaggtcggcgaggcgcggggaggttttcggcggtcgagggaagttgtataggagttcggtttttgtttcgagcgggtgtacgcgcgggggtgtcgtcgtttcgtgcgcgcgagtgatttatttaattttaatttagcgttgcgggggaaataggaaatttttcgttaatagttgggtaggattttttttcgttcgagagtttttttttttttttcgacgtttagtttttagttttttcgtagttgttaattatgttttttagattagttttttcgagagttttggtcgatttttagttgttttttatcgtttttttatattatttaggagtttttcgttttaagtatttatttaagaatgattaagtgtatatagtttataaagtaataatagaaaacgtttacgttttttttagtagattagaatatttgtcgtttttttttagttttttttagattgtttttaggtgttttagagatgcgtttttaaattgtaagttgagatttaggagtgaatattttaatttattgagtcgcgagtatattttttttttaaataaaatagtaacggtaaattttattttattaaatttgtgttttagttgtgtttatatgtatgtatgtatgtgtatatattgttaagttgtaaaatgtttttttttaggtcgaagtttagaggttttttttaagttttaatgtatatattgattatttggaaattttatttaaaaatgtagattttaatttagtaggtttaggaggtaggtagagattttgtatttttaatgagtatttggatagagcgttttattttgtatcgttttttttcgggattgagttagtgagtaattgtaaatgattatttattacgaagtgatagtggtgggaaatgtaatttttagaatgtatagagtatagtagaaattgtaaaattaaaagtgggttgggagttatttgaatgtttgtgtttttatttttttaatgtaggtgaagaaagagaatatttatttttttatgtgtaaacggggtaatatgggagtagaatagtataaatttttaaatttttttttttgttagggtaattagatttgtttaagatatttttggtgtatatgttttgtagtttaaatattaatagaatttttttttttttttagatatgttttgattggataataaattatgtgattaatttattttttatttttaaagatatgattttgtatagttttttggttagtagattttttagtaatttatttaatgaatttttttatttgagaggaagattgtagaggtaagggtttgtgttagggtttttagggaataaaggtaaatagtttttttttaaatttaatttttaaattttttttgttattttaagtgtttatttgttttattttggaattttaatttatgttttatttagtatttaagttgtttttggatgttttgttattttttagtatttatgttgaagatgtagaaagtgtagtgaaattaggagggttaggtatttttttttttattaattaattgttttgttaaagttggagtgattttgttaatggaggaagattgagttttaaattttttttttatttttttttttgttattagtttatgttattgttatggtttgtgtaggagttttttacgagttatttttagttacggtcgttttgggtttttttatttagttttttaaacgagagttgaatttagttttttaaaatataaaattagttatattaattttttgattaaaattatttaatggttttttattgtttttgagataaagagaagataaaaattagatttttgaacgtgtttttaagtttttaattttttcgtaaatttttatttggtttttttttgtttattgaaagttttttttaaatttcgtgaatatgtttttgtaatttttttattttttatgtttagagttttttttagtgtggattttttttttttgatttttttttttttatttagttaatttttggttttcgtggattgaattataatttttttgatgggtaagtttttttttatttttatgagtagattttgtattatacgtttttttggtattatatgttttttttttaatagttgtaattttataattatttgtgttattttttaatttatatttttattttttatttaattttaaattttttgagggtaggtattatgtatttttttttttatttattattgtgtttttaagtattaaatatataatcgatgtttaataaatatttgttggatgaatgaatgaattaggtaataaagatttagaagaaaattgtatttgattgttttagttgttttataattttggagaaaatattgttatcgaatatttgagatataaatagattatattttagtcgagaatgatgttattattattttttttttttaagaatggagaagtatgtgggttttt

SEQ ID NO: 232 - DNA, 4001 bp, Artificial Sequence
  chemically treated genomic DNA (Homo sapiens)
acgtttagttaatttttgtattttttagtagagacggggatttattacgttggttacgttggtttggaatttttatttttaagtaattcgttcgtttcggttttttaaagtgtaggcgtgagttatagcgtttagtttgattttattttatatgaagttttttaataggtaaaatggttatggagattaaaataaaggtggggtcgggaatcgattgggaagagacgtgatgaaacgtttttgggacgatgaaaagggtttgtgatttggtaggtattacggagcggttaggggttaaaatttatttttttgtgtatttgttgtgtgtattggcgttgtgtgtaaatgttatttcgatttaggaaaaagatgacgtaagtacggtataaagtggtcggtacgcggtaggtgtatgggaagaaattgcggaatgaaataatcgcgagttaagagatggggtagcgggagaaatgaattcgagtttcgttttttattaggaagaatcggttcgggtcggagggttgtacggaggattatacggacgtttgcgggttcgtttttttcgttttacgacgtttagtttgcgtttggaattggaatggtttagtttaaagttagataataggtagattgttttttcgataaattattaaacgatttattattgtatttttttaaaatttgatttttagacgtatttattttttttttttttttttcgggaagatgagatatatttatttttgaaaatattttcgggtttgttttttgtatatttttttttttttttgttttacgttatggtagcgttcgtttaggttgtaggcgattcgcggggtggggtatattatttaaagaaggggagggattgaggtttgtattaaaataaatatttttgtttttgtaaaggttataattaagtaatttagaaaaagaaatgtaggcggagaatagtagtttttttttgttaagtaagaggaatcggtttaaaggatatttttttttttttttttttttttttatcgggtgaatagtgagttgtttcggtaaaaagaaatcggaaatgttgttgtaagaggtagaaatgtaaatgtggagttaaataataatagggttgtcgggttttttagattgcgacggtttttttcggtttggcgggtaaatttttggtttagtattttttatttttacgattgatagtttttaattggattttttttatttagcggagtcgggggttgtttggaaagatcgttttaggaaggataaaggttcggaagttgtgggattttagtagtttgggtttttcggattatttttaaatgattatttcggaatggagttttagtttttattaggatgttatgggttttaaaatatatagttatgagtttttaatgtttcgagatttaaaagttttagattttaatgttttgtgtattttttattttagggattttttacgtttagtatcgggtggatgtgtaaagaagtacgttttaggtcggtttaaggttttttaaagttttatttttttgtttaggcgtttaattttgagttcggatggttttaatatttttattatttatatttaggttttttaataatgtaatttttatgatgatttttttagttaagtttttattttatttatttttaaattcgttaagtttttattgttttatttttagttttagcgattttttcgagttgaaaatatacggagtcgagagttcgtgatttagagaggatttattaagtttagttaggagtttatttaatttagggaagcgtgttatcgtcgtggaaagtacgtttttagttcgaacgtaaagtgttttcggagtttagtagttatttgttttttggacggtggttttagatttttgagaagtttaaaatttttagcgttagttttgagtatatgggaggggaaaattttaattttattaatttttgcgaggtttttggtataaagttggatagtcgttatgataagtaagggtaagtaattcgtttgtcggaggaagtaaaggaaatggagttggggaggagggtgtagagttaggattttcgtcgatttggtgtcgtagatattaatattttggggtggaaaattttgtaagttagagttgtgagggtagaattggtggaaattattttggaggaattttgtattgtgttaaatatgaagggtggaaggaagaaagtttttgcgtttgtttttagttggattttttttttttattagttaaaatgttattttttaggaaggtttttcgtaatattatattttaacgtttttttttagatattttatattatattattttatttaattttttttataatttttattattttgataagatttatttgtttattgtttttagtatatggaaacgtaagttttatgaggatatagaatttttttattattttatttattgttgtatttttgagtgtttatattagtgttgggtagtaagtaagagttcgataataaatattttttgaatgagggagataggtttgaagtttggagaatgagatgtagaagaggtgtaagatttgttgcgttttttgtaggcggcgggggggcggtgtaggtgttttaagaattatcgcgggattcggtagggggagcgtaggcgtttttcgttaagatagaagcgtttagattataatttttagtagttacgaggagttttagggtttgatgggaacgggaaattttttaattttttacgtttcggtttcgcgggtttcgtgggtcgttcgcgaaatttgattcgggatgcggcggtttaatcggaaggtggatcgaaatttcgcgatagtaagaggttcgtagcgattcgcggtgttaaggaatatagtgtttttaaaagaattggcgttcgttgttcgttttttttttcgggagttttttgtttatttttagaagaggagggaagtataggtgggtttttttagttttgcgtcggatttttgagaatttcgaagttattttggttgaggttaattttcgttgtgttttttttgtagtatgaagattttggagatttaatcgttagtttcggattgttgttttttagattaggatttagttttagtttatttttttttttacgttttttcgatgaataaaaatgcggattttgaattgatgttatcgtttttcgaaaggggggattcgtttcggttgtttttagattttgtggttggtttagttgtgttttaggagttacgggagggggatttagtttttttttttatttttttggaaatagagtttggtttttttagtgagttgagttttcgaatcgaggagtaagaattttttgaaaatataagtttttttgtagaagaagtaaacgggagtttttttgaagaagaagcgaacgggttagagttggggtttggaaaagttatggaagatatttttggggaattcgttgtagaggacgagggagatacgtaagtggtgatggtagtggagtgtggagtttggggagatgaagtgtgaggtcgatttgttttttggttttgagatttatttttttaggtttttgttttttttgtttggcgatttaggtttattgttttttattttttttttagcgtttggaattatagttttttttagttgtttcgattttttagtggtttttggttagagtttagtatttaatttgagaattttttgaaaggttgtaagtggtaaggataataacggggtagggagttgattattttcgagatttttattgtaaaatagtttagttttttaggagagggatgttttagagttgggagaagcggtacgtagtttttttagattgagtttatattttatttagtagtttgtgttttttattttttttaaggatttaggggggtttatttattttagaggtaggtttagttttagttttatatttgaaaagtataggtttggttagttttttaatttttttttgtttttagggtttttgacg

SEQ ID NO: 233 - DNA, 4001 bp, Artificial Sequence
  chemically treated genomic DNA (Homo sapiens)
cgttaggagttttagaaataggggagagttagaaagttggttagatttatgttttttaagtgtagggttagggttgagtttgtttttggggtaggtaagtttttttgaatttttgagggaagtagaagatataaattgttagataaaatgtaagtttagtttaaaagggttacgtgtcgttttttttagttttggggtattttttttttagaaaattggattgttttatagtgaaaatttcgggggtggttagttttttgtttcgttgttatttttattatttatagttttttaagaagtttttaggttgggtgttgaattttgattaggaattattgagaaatcgaggtagttgggagaagttgtagttttaagcgttgaaaggaagatgggggataataaatttgggtcgttaagtaaagggggtagaggtttggagaagtgggttttaggattagaggatagatcgattttatattttatttttttagattttatattttattgttattattatttacgtgtttttttcgttttttgtagcgggttttttagaggtattttttatggtttttttagattttaattttggttcgttcgttttttttttagaaaggttttcgtttgttttttttgtaggaaggtttgtatttttagaaagtttttgtttttcgattcgaggatttaatttattaggggaattaaattttgtttttaggggagtggagagagaaattgggtttttttttcgtagtttttgggatatagttgagttagttataggatttggggataatcggggcggattttttttttcgggaggcggtggtattagtttagagttcgtatttttatttatcggggaagcgtggggagaaggatgggttggagttgggttttggtttgaaggatagtagttcggagttaacggttgagtttttaaagtttttatattgtagaggaagtatagcggagattagttttagttaggatggtttcgaagtttttagggattcgacgtagagttaaagaaatttatttgtgtttttttttttttttgggagtaggtagaagattttcgggaggagaggcgaatagcggacgttaatttttttgaaagtattgtgttttttagtatcgcgggtcgttacgggttttttgttgtcgcgggatttcggtttatttttcgattgggtcgtcgtatttcggattagatttcgcgggcgatttacggaattcgcggagtcgggacgtgaaaggttagaaggtttttcgtttttattaagttttagggtttttcgtggttgttgggagttgtagtttgaacgtttttattttggcgagaagcgtttacgttttttttatcgagtttcgcggtaatttttaaagtatttgtatcgttttttcgtcgtttgtagagggcgtagtaggttttgtattttttttgtattttattttttaggttttagatttgttttttttatttaaaaaatatttattatcgagtttttatttgttatttagtattgatataggtatttaggaatataataatgaataagatagtagaaaaattttatatttttataaggtttacgtttttatgtattgaaagtaatgaataaataaattttattagagtgataagggttgtgaaggagattaaataagatggtgtgatataaagtatttgggagaaaacgttagggtgtgatattacggaaagtttttttaaaaaatgatattttaattgatgagaagaaaggatttagttgagagtaaacgtaaaagtttttttttttttattttttatatttgatataatgtaggatttttttaaaatgatttttattaattttgtttttatagttttggtttgtagaattttttattttaaaatgttagtatttacggtattaggtcggcgagaattttgattttgtatttttttttttaattttattttttttgtttttttcggtaggcggattatttgtttttatttgttatggcgattgtttagttttgtgttaggagtttcgtaggggttgatgggattggggttttttttttttatgtgtttaagattggcgttaaaagttttgagttttttaaaagtttagagttatcgtttagggagtaggtagttgttgggtttcggggatattttgcgttcgggttgggagcgtgttttttacgacggtgatacgtttttttggattgggtaagtttttgattgaatttgatgagttttttttgagttacgggttttcggtttcgtgtatttttagttcgggaaaatcgttggggttgggggtggggtagtggggatttagcgagtttgggggtgagtgggatggaagtttggttagagggattattataggagttgtattgttgggagatttgggtgtagatgatggggatgttaggattattcgaatttaaagttgaacgtttaggtagaggagtggagttttggggaattttgagtcggtttaaagcgtatttttttgtatatttattcggtgttgggcgtagggaatttttgaaataaaagatgtataaagtattgaggtttgagatttttggatttcgaaatattgagaatttatagttgtatattttagagtttatggtattttagtgaaaattggggttttatttcgaaatgattatttgggggtgattcggggagtttaagttgttaaggttttataattttcggatttttgttttttttggagcgatttttttaggtagttttcggtttcgttagatggagaaaatttaattgaaggttgttagtcgtggaagtgagaagtgttaaattaggggtttgttcgttaggtcgaggaggatcgtcgtaatttgagaggttcggtagttttgttattgtttggttttatatttatatttttgttttttgtagtagtattttcggtttttttttgtcggagtagtttattatttattcgatgagaggggaggagagagagagaaaatgttttttaggtcggttttttttatttggtagagggaggttgttatttttcgtttgtatttttttttttggattatttagttatggtttttgtaaaggtaggggtatttgttttgatgtaaattttaatttttttttttttttgaatggtgtgttttatttcgcgggtcgtttgtaatttaggcggacgttattatggcgtgagatagggagggaaagaagtgtgtagaaggtaagttcggaggtatttttaagaatgagtatattttattttttcggaggaaaaaaaaaaagaatgggtacgtttgagaattaaattttgaaagagtgtaatgatgggtcgtttgataatttgtcggaaaaataatttatttgttatttagttttgggttaggttattttagttttagacgtaggttgaacgtcgtgaagcggaaggggcgggttcgtaggcgttcgtgtggtttttcgtgtagtttttcggttcgagtcggttttttttggtaggaggcggaattcgaatttatttttttcgttgttttattttttagttcgcggttgttttatttcgtagtttttttttatgtatttgtcgcgtatcggttattttgtgtcgtatttacgttattttttttttaaatcgaggtggtatttatatatagcgttagtgtatatagtaagtgtataggaagatgagttttggtttttaatcgtttcgtgatgtttattaagttatagattttttttatcgttttagaaacgttttattacgtttttttttagtcgattttcgattttatttttattttgatttttataattattttgtttgttggagaattttatatagaatggaattaggttgggcgttgtggtttacgtttgtattttgggaggtcgaggcgggcggattatttgaggataggagttttagattagcgtggttaacgtggtgaattttcgtttttattaaaaaatataaaaattagttgggcgt

SEQ ID NO: 234 - DNA, 4607 bp, Artificial Sequence
  chemically treated genomic DNA (Homo sapiens)
tgttatttatggaacgaagattttaaattttagttatgaggataattatttttttatttggggatagaatattagtatttaaattatttattcggtatgtggtagaggagaagagaattagaggagaagtagagatgataaagtagttatattatttattagtttataggtaatagaattattaatttgttttttgtgataaagtaataataaagagtcgatattttttatatttttatttgtgtgtagtcggtattgtcgatatttatttttttaagggtatttttttagattttttatttgtttacggtatttttttgggtttcgtatttgttcgggtatttgtcggggttttgtatttgttcggtttttatatttgtttggggtatttgtttgggtttcgtatttgtttggggtatttgtttgggtttcgtatttgtttggggtattttttcgggttttttatttgtttagggtatttttttgggtttcgtatttgtttggggtatttgtttagatattgtatttgtttcgggtatttgttcgggtttcgtatttgttcgggtatcgtatttgtaggatttttaagttgtttttatttacgcggtcgttttcggttttgttcgtcggggacgttggtatcgaggatgttttgttcgtggtttaggttttcgtcgtttattaggtatttgtcgttcggggagaatttgtagagtaagttggagagtttgaatatttcggagaagtttatggtcgtcgtttgtcgcgggcgttattttgcgttcgaaaattcgcgggatttttgggcgcgtagtaggttgtaatagtcgacgtcggttttcgaggtcggaagttagaaggcggaagtgaattgtagtttattagcgtcgtcggttttcgcgcggtattgtggggtttgtagtttttgtgtcgtagggttttaaaggaaacgtttacgtttttttcgattagggattttcgattcgagaattttattttaaaggtcgggaggtttttgagtatttttagttagggttgttgataaaaatgtagaaagtatagtaaaatttgaattttagatttataataaatttagttataagtatgtttttaaatattgtacgggatatgttaatacggaaaaattattcgttagtttgaaatttaaatttaattgagcgatttgtgtgtttgcgtgtgtgtatatatgtatatatatatatttatatttatatgtaaatgtatgtttatatgtaaatatatgtttatttataaatatatttttaataagtaatacggtgtttgtcgtatatatattatatcgtgtatgtaatgtataagtatttatttcgtttgtttggggttttgtttgtttttgttgagttcgatttttttatttgtcgtttggtttttgttttacgttttagtgttattgagattaaggagagaacgaatttgtcgttgattgggtagagcgagcgcgtggatcgcggttatcgttcgtttattattcgcgcgtatttgggttggtatcgggcgaagaatcgtgcgggtttgggatttgggggtttagagggagcgagtttttgcgcgggcgttcggttcgtaggtttcgtaggtttaggggcgtgtttcgtttttatttttatttcggatttcggtttttttttttagatagcggttttttttatttttggttttcgtaggtcgttagtagttcgcgttaggtttcgtcggcgtttttagggttttttagatcgcgtagattttgatattttcgtttggttttgggttttgggagttgagagtcggttagggttttgttcgtattttcgggcgtttagtttcgggtttgtttttcgcggacgttttaattttttcggtcgaatggatggtggtgcgcgcgcgttttatttcggcggtgtcggttttttttgttgttaaaattagatttaaatttttgtatgggattcgtttttgggtttttatttcgtgcgtttagtaaatagtgggtgagttatgaagatgtgcgagttagtcggatttttttcgttaggcgcggattcgttgcggttagagaatttagtttgcgttagttcggttcgttcgcgaagttacgggttttattgacgcgattttttaagacgtgggggttattatgggtagaggatatcggttcggagttagattacgggttttataagtattagattataagtagcgtcgttattgagagtcgttcggaattcgtttagtatgtcgggttttttagttagggtttggtgtacgtggtcgagggttttggaagtttcgatggtttaggaggagtaggcgggcggggcggcgggtgtcgttggtcggtagagagtttcggtttgatttagcgtaggtttggtgcgcgtagagaataattttaagcgtatcgacgttcgcgagttttttttaaatatcgaacgggatttagagttcgagtttataggcggcggtcgggggagggagtagggtgttggtcgtcgttcgggagtgttcgcgttttgggtgatttttggaaggacgtggggtttaaatttcggttggggttgggagagtagtttttagaggtttttcgcgggattttttgtcgggcgggatcgtggttttataggagaagtgggtggtaagttttgtttggcggaaagtagtcgtttttttttttttgggtttggggcggcgttttttatttttgtttttcgttttttatttttgtttttcgtcggttatattttttgttttttggattttaagcgtttcgcgcgtcgaggagtttagcgttagtggcggcggttaggagagattcgggtgttaggaaagatgggtcgtttgggggatagtagggagttcgggggaaacgtaggcgtcgggtatagagtcggtatcggcgtttttagttttgtcgaagatcgcggtcgggtttggttcgcgggaggggttttggcgtcggatttgtttcggttttgcgtgggcggtttcgtcgggttttgtaggagcgacgcgcgttaaaaggcggcgggaaggaggcggggtagagcgcgttcgggatttcgatttggacgcggttagttggagaggcggagcgtcgggaggagattttggtttcgtcgcgattcggtggttcgcgttgttttttcgcgcgtcgggttaaaaaggcgttaacgttcgcggtcgtttatttttcgcggcgtttttttttttcgcgtttatataattcgtttaggggtcgggtagttcgttttgttttttcgttcgcgtattcgttcggaggttcgcgcgttcgcgaaggggacgtagcgaaatcggggttcgcgttaggttagtcgggacggacgtcgatgttcggggttgcgacggttgtaggtaggaggtttagggtcggggggcggttcggtttcgcgggcgggggttggagcgtagcgttgggtaggtatttgggttcgtagtttcgaagttgggaggtgaggggagagcgatcggggacgagttgggataaggcgatataggggttttttcggagttggatcggtttttgggatttggcgttcgcgagaggttggagcggttagagtttagtttgcgaggagacgcgggttttgtttttagcgtcggtcgtttttggcgttaaagatagtttcgtaggggtttcgggagggttttttttttgttgttttttttttatttcgggtttcgagggtcgttgggagggtaatttcgggaagaggtcggggtgcggggcgcgggtgtaggtggaaatcgttagtaagttttttttcgttcgcgcgtttttttcgatttgtagggttgtgttaatttcgaggttttagtttttttgaggagttagggttaggtttttttttggatagggagaaggatttgggcgggggttttgatttatggagttggttattaagcggtttcgatggtttttcgagggatagttttttgtggttttgagtttgtttgtcgagggtttttggtttgttttcggagcggttttaggtagagaaagttcgtgaagaaatggttcgggtcggtttggagggagatattttacgtttttttagtttttgggtcgtttttttttgtagtttttgtttttttcggggtttggatttggggagcgatgattatttttgtttagtttgtattttggtttggacgttaggagataagtttatgtagtatgtatacgtttgttatataaataggggatagatagacgatttttaattagtaagggtgtagggaaaagtaatgtattttaaatttttgattagaggttatttgtttttaaagatgttgttatttgtttatttattgtttggatatttggaaatggtttaggtttattaatataatgttttggtttttgttgttttgttttttgttgttgttattgttgtttatttgtttagttttagttttgggggaggagtaaataaagcgcgtggtttttggtatttattgagcgttgagttatttttttttggatttattcggggaaagattaaaaagtattttattaagaataggatacggtgtttgaaatgttgttatatatgaatgtatgtatt

SEQ ID NO: 235 - DNA, 4607 bp, Artificial Sequence
  chemically treated genomic DNA (Homo sapiens)
aatgtatatatttatatatggtaatattttaaatatcgtgttttgtttttaatgaaatgttttttaattttttttcgaataaatttaaagaggggtggtttagcgtttagtaagtgttagaggttacgcgttttgtttattttttttttagagttaaggttgaataaataaatagtaatgatagtaataaaaaataaaataataaaaattaaagtattgtgttaatgagtttgagttatttttaaatgtttagatagtgaataaatagatggtagtatttttggaagtaaatgatttttggttagaagtttggggtgtattgtttttttttgtatttttgttggttgaagatcgtttatttgttttttgtttatgtagtagacgtgtgtatattatatgggtttattttttagcgtttaggttaaaatataagttgagtaaaggtaattatcgttttttaagtttaagtttcgggaaaggtaggggttgtaggaggaggcggtttaggagttaagggggcgtgaggtgtttttttttaggtcggttcgggttatttttttacgggttttttttatttgggatcgtttcggagataggttaggagttttcgatagataaatttagagttatagggagttgtttttcgggaaattatcgaaatcgtttagtaattaattttatgggttaaggttttcgtttagatttttttttttgtttagaggggggtttggttttggttttttagggaagttgaggtttcgggattggtatagttttgtaggtcggagggagcgcgcgggcggggaggagtttgttggcgatttttatttgtattcgcgtttcgtatttcggttttttttcggggttatttttttaacggttttcggagttcggggtggagaggggatagtaggaggagggttttttcggaatttttgcggggttgtttttggcgttaaaggcggtcggcgttgagggtaggattcgcgttttttcgtaggttagattttggtcgttttagtttttcgcgagcgttaagttttaggggtcgatttaatttcgagggagtttttgtgtcgttttgttttagttcgttttcgatcgttttttttttattttttagtttcggagttgcgagtttaggtgtttgtttagcgttgcgttttagttttcgttcgcggagtcgaatcgtttttcggttttgggttttttatttgtagtcgtcgtagtttcgggtatcggcgttcgtttcggttggtttggcgcgggtttcggtttcgttgcgtttttttcgcgggcgcgcgagttttcgggcgggtgcgcgggcggggaggtagggcgggttgttcggtttttaggcgggttatatgggcgcggggaggggaggcgtcgcggggagtaggcggtcgcgggcgttagcgtttttttagttcggcgcgcgggaaggtagcgcgggttatcgagtcgcggcggggttaaggttttttttcggcgtttcgtttttttagttggtcgcgtttaagtcggggtttcgggcgcgttttgtttcgtttttttttcgtcgttttttggcgcgcgtcgtttttgtagagttcggcgaggtcgtttacgtagggtcgaagtaggttcggcgttagggtttttttcgcgggttagattcgatcgcgattttcggtagagttggggacgtcggtgtcgattttgtgttcgacgtttgcgtttttttcggattttttgttgttttttagacggtttattttttttgatattcgggttttttttggtcgtcgttattagcgttgggtttttcggcgcgcggggcgtttggaatttaaggggtaggggatgtggtcggcggggaataggggtgaggggcggggaataggggtgaggggcgtcgttttaggtttaggaggaggggaacggttgtttttcgttaagtagggtttgttatttattttttttgtggagttacggtttcgttcggtagaggatttcgcggagagtttttgggggttgtttttttaattttagtcggagtttgggttttacgtttttttaggggttatttaggacgcgaatattttcgggcggcggttagtattttgttttttttttcggtcgtcgtttgtgggttcgggttttggatttcgttcggtgtttggaaggagttcgcgggcgtcggtgcgtttggagttgttttttgcgcgtattagatttgcgttaggttaggtcgaagttttttatcggttagcgatattcgtcgtttcgttcgtttgttttttttaggttatcggggtttttagggttttcgattacgtatattaggttttggttaggggattcgatatgttgggcgagtttcgagcggtttttagtggcggcgttgtttatggtttgatgtttatggggttcgtgatttggtttcgaatcgatgttttttgtttatggtgatttttacgttttggaaagtcgcgttagtgaagttcgtggtttcgcgagcgagtcgggttggcgtagattgggttttttggtcgtagcgggttcgcgtttgacggggagggttcggttgattcgtatatttttatggtttatttattgtttgttgggcgtacggggtggggatttaaagacgaattttatgtagaggtttgggtttagttttggtaatagaaaaggtcggtatcgtcggagtaggacgcgcgcgtattattatttattcggtcggggaggttggggcgttcgcggggagtagattcgaggttgggcgttcggaggtacgagtaggattttggtcggtttttagtttttagaatttagggttaggcggggatgttagggtttgcgcgatttggggggttttagaggcgtcggcggggtttggcgcggattattagcggtttgcgggagttaggggtggagggggtcgttgtttagggaagaggatcggggttcggagtgggggtgagaacgaggtacgtttttgagtttgcgaaatttgcggatcgagcgttcgcgtaggagttcgttttttttgggtttttaggttttagattcgtacgatttttcgttcggtgttagtttagatgcgcgcgggtgatgaacgggcggtggtcgcgatttacgcgttcgttttgtttagttagcggtaaattcgttttttttttgattttagtggtattggagcgtgaggtaagggttaggcggtaggtagaggggtcggatttagtaaaagtaaataaaattttaagtaaacgaaataaatatttatatattatatatacgatataatatatgtgcgatagatatcgtattatttattaaagatatatttgtaggtaaatatatatttatatgtaaatatatatttatatataaatataaatatatatatatgtatgtgtatatatacgtagatatataggtcgtttaattaaatttgaattttagattagcgagtaattttttcgtattagtatgtttcgtgtaatatttgggaatatatttataattagatttgttgtgaatttgaaatttaaattttattgtgttttttatatttttattagtagttttagttggaggtgtttaaaggtttttcggtttttgaggtaaggttttcgggtcggaaatttttggtcggaagaaacgtgggcgttttttttaaagttttgcggtataagaattataagttttataatgtcgcgcggaagtcggcggcgttgataggttgtagtttattttcgttttttgattttcggtttcggaggtcggcgtcggttgttgtagtttgttgcgcgtttaggggtttcgcgggttttcgggcgtagggtggcgttcgcggtaggcggcggttatgaattttttcgaggtatttaagttttttagtttattttgtaagtttttttcggacggtaagtatttggtgagcggcggggatttgggttacgggtaggatattttcggtgttagcgttttcggcgggtagggtcgggggcggtcgcgtgggtggaggtagtttggggattttgtaggtgcggtgttcggataggtgcggggttcgggtaggtattcggggtaggtgtagtgtttgagtaagtgttttagataggtgcgggatttaggaagatattttagataggtggagggttcggggaggtgttttaagtaggtgcggggtttaggtaggtattttaagtaggtgcggggtttaggtaggtattttaagtagatatgggggtcggataggtgtaggatttcggtaggtgttcgggtaggtgcgggatttaggaagatatcgtagataggtggggggtttggggaggtgtttttggaaaggtgggtatcggtagtgtcgattgtatataggtgagggtataggagatgtcggttttttgttgttattttgttataaaaggtaaattgatgattttgttgtttgtaaattggtaagtggtgtggttattttgttatttttattttttttttaattttttttttttttattatatgtcgaataaatgatttaaatattagtattttatttttaggtaaggaagtagttgtttttatggttgggatttgaggttttcgttttatgggtggta

SEQ ID NO: 236 - DNA, 4453 bp, Artificial Sequence
  chemically treated genomic DNA (Homo sapiens)
ttggttttgaagtttatagtatcgttgatttagtttgttttttggaaggttggtagtttagtaagtatagaagtttttttagaagatagtgggttatttgttttttaaaagttgaaaggttaatttgtattttttttagtaggtagttggtattttgagttttcggttggggtagagtaaaggagttttttttttttttatttttttggtattttttttgttttttttttgttatttttaggtggatttagatttaaggtttagatttgtaaggtaggaaaatgttgtaggtttaggttgggaaagggtttaaagtcgttagtggattgttgggatttagtttttttttttttattaagagagcgagttttattgggtttaaaatgattttaagttttggtttttgatattaggggaaagagatgggggtgatagaattatagaatttttgttatgtttttttaagtgtgtttagagatgcgtgtgtgtgtgtgtgtgtatatataaatgtttgtttatttttaggtaggaagggtggatgtagttatttatatatggtttgtttttttggaggataattttatttgataaataattgtttttatttgaatagaataaataaggttttatgatgaagtaaaatattaaatatatatgtattaaaaaatgtataattatttttttggaatgggttatatagagatgtgttttttaaaatgttaagagtgtaaaaggataaatagtgaaaaataaattttttttttattttgttttttagttttttaatttttttatttagaggtgagaatagaatttttatattttttagaatttttatagttagaattgtttatatgtttttattgtttttatttttatttttgtttgtataaataaatgaattgtttattatggaaattttttaaaagattcgttaatattttaataggaagtattaatagtttatgttttaggattttgtttttataattttgtaatattatattacgatatttaatttaatttttattaagttttgttaaaaacggattttaaattaagttgtaaatttttagtaatttggttttgtttttttttttttgatagtattattaaataaatttttttattgtcgaaagtaataagttcggttttgttttatttattggttgtgttggtgatatttggggattgttattgaatagacgtatagagggagtttttataggtaggggtttttttgtttgtgtttttgggagagtatgtttcgtatatttgtcgcgttgatgaagattttatagttttattagttgcgggtaagggggtttgaggtagttttaggtaagttggggtttagcggggagaagttgtagaagaattgattagaggattttaggaggttttagagttgggcgaggtagagagttttttgtgcgtttttttttttttttgtaattcggggattttttgtattggggtaggttttcggttaggtgtatgggaggaagtacggagaatttataagtttttcgattttttagtttagacgttgttgggtttttttcgttggagatcgcgttttttttaaatttttgtgagcgttgcggaagtacgcggggttcgggtcgttgagcgttgtaagataggggagggagtcgggcgggagagggaggggcggcgtcggggcgggttttgatatagagtaggcgtcgcgggtcgtagtatagtgcggagatcgtagtttcggagttcgggttagggtttatttgttttcgtagcgtcggttcgcgtttttttgtcgtagttatcggtgagtgtcgcggttttgagattttcgggtcggatgcgcggcggttttagttttcgagcgtttgtttttttcgttttgggttgttcgggttttttgggtttttcggcggttgtacggagttaaggcgtttcgtttcgggcgtttttcgcgggtgtcgatttaggttgttcggagttcggagtttagagaggagagagatagttggggagtttggttatcgcgggtattttttttgcgttgtagtcgttcgtttggtttgttttttcgttttttcgttttttgttttgattttttttttttttgtagagtcgtcgtttagcgtttcgatttcgttattatgagagttttgttggcgcgtttgtttttttgcgttttggtcgtgagcgattttaaagtgagtgcgtttttgttttgattgatgttgtttaaggatttttgattagtattaggggagaggaggggttgtttagggagttggggtttttcggattttatttatagtagggttagattttttttaggaaatgggatagggtggtagcggaggtttgagaattacgggggttggtattggttggtaagggaggaagaggtcgtcgggattgttttagtttgcgggtatttggtagatgaagtttgtttgggttaatttattttttttggttggaaatttatggttttttatttgagaattagatacgaatagggtgaggcgagagggagagggaagagtgggttttgggattggggttagtttatttttattttggagtttttggagtatgggatttttgatgaagttttttttcgaattttttttagggtagtaatgaattttattaagttttatgtgagtatttatttttataatagttggttgtatagataagttgggaaggttttaggggatattttttttttgttttttgttgtagggttgcgttattttttattatttttattttttttcgtttattttatttttgttttttttagcgaattgtgattgtttaaatggaggaatatgtgtgtttaataagtatttttttaatatttattggtgtaattgtttaaagaaattcggagggtagtattgtgaaataggtatggggatttttattgtaattgggagagaaatttggggatagggagggatgggtgggaggtaagagtaggtaggagttaggagttggaggtagggtgggtgatatttttatttttatgtgataagtataaatatatatatacgtttacgaaatagtggttatataaatgtgaggtggggttggaaggagattttgtttagttttttggtaggtttgaaacgatatttttaaaatgttcgttggtagtcgggtatggtggtttacgtttgtaattttagtattttgagaggttaaggtgagtggattatttgaggttaggagtttaagattagtttggataatatggtgtaattttgtttttattaaaaatgtaaaaattagtttggtatggtagtggatgtttgtagttttagttatttgggaggttgaggtaggagaattgtttgaatttgggaggtagagattttagtgagttgagattatattattgtattttaattgggcgatagagtaagattttattttaaaaaaaaaaaataaaagttagttggaatgttttttttttttttatatttttttatttttttgtttttttgtagataagttaaaaatttgttatgaggggaatggttatttttatcgaggaaaggttagtattgatattatgggtcggttttgtttgttttggaattttgttattgttttttagtaaacgtattatgtttatagatttgatgttttttagttgggtttggggaaatataattattgtaggtgaggtgggggtaataaggattaaaagttttttttatagttttttagaaattttgttattattttttttttttagagggttggttatagtataagagaagtgcggtttttggttgagttttttttgaggggaggaggtagggaaggttttttgggttggaatgatattttttatttttttgtgttgttaggaatttagataatcggaggcgattttggtgttatgtgtaggtgggtttaaagttgtttgtttaagagtgtatggtgtatgattgcgtagatggtgagtattattgatttgttgatgatagtggggtggaaggggataaatttatatgtttttttattttattataggaggattgaggaggtggggggtgttcgagagggatgtttttttttatttgtttttttaagatatttttttgtttgttttttaggaaaaaagttttttttttttttagaagaattaaaattttagtgtggttaaaagattttgaggtttcgttttaagattattgggggagaatttattattatcgagaattagttttggtttgcggttatttataggaggtatcgggggggttttgttatttacgtgtgtggaggtagttttattagtttttgttgggtgattagcgttatatattgttttatgtacggttttgggtttttttttttcgatttttttgttttattttaagtatattttttttttttttttagtaaagtgtttcgttttattttttttttatttgtt

SEQ ID NO: 237 - DNA, 4453 bp, Artificial Sequence
  chemically treated genomic DNA (Homo sapiens)
ggtagatgagggagaaatgaggcggaatattttgttgggaaggagaaagggatgtgtttggggtggggtagaagagtcgaagaggagaaatttagggtcgtatatgaagtagtgtgtggcgttgattatttagtaagggttgatgaggttgtttttatatacgtaggtgatagagttttttcggtgttttttgtagatggtcgtaaattagggttggttttcgatggtggtgaatttttttttaataattttaaagcggggttttagagttttttggttatattgaaattttaatttttttggaggagaggagggttttttttttggaggataaatagagggatgttttagggaggtaggtaggagaaagtatttttttcgggtattttttatttttttagtttttttgtgatggaataaggggatatgtaagtttgtttttttttattttattgttattagtaggttagtgatgtttattatttgcgtagttatgtattatgtatttttggataagtagttttaggtttatttgtatatagtattagggtcgttttcggttgtttgggtttttggtaatatagaaagataggggatgttattttaatttagagggttttttttgttttttttttttagggaagatttaattagaggtcgtattttttttgtgttatggttagttttttgggagaaggggatggtaataaggtttttgggaagttgtagggagggtttttggtttttgttgtttttattttatttgtagtaattatgtttttttaggtttagttgaagagtattagatttgtgggtatggtacgtttgttgaaggatagtggtagagttttagggtaggtagggtcggtttatggtgttagtgttggttttttttcggtaaaagtgattattttttttatagtaggtttttgatttatttataaggggataggaggatgagagaatatgagaaagagaagaatattttaattaatttttattttttttttttgagatggagttttgttttgtcgtttagttggagtgtagtggtgtgattttagtttattgagatttttgttttttaggtttaagtaatttttttgttttagttttttaagtagttgggattataggtatttattattatgttaggttgatttttgtatttttagtagaggtagggttatattatgttgtttaggttggttttgaatttttgattttaaatgatttatttattttgattttttaaaatgttgggattataagcgtgagttattatgttcggttgttaacggatattttaaagatgtcgttttagatttgttagaagattggatagggtttttttttaattttattttatatttgtgtggttattgtttcgtgagcgtgtgtgtgtgtttatgtttgttatatagggatgaagatgttatttattttatttttagtttttaatttttgtttgtttttgttttttatttatttttttttgtttttaaattttttttttagttgtagtggagatttttatatttattttatagtgttgtttttcgaatttttttgggtagttgtattagtgaatgttggagaagtatttgttggatatatatgtttttttatttagatagttatagttcgttggagagaataaaggtggggtaagcgagggggagtggaagtggtaaggggtggcgtagttttgtagtagagggtagggaggggatgttttttgaagtttttttaatttgtttgtgtagttaattgttgtaggggtggatatttatatggaatttgatgaagtttattgttgttttggaagagattcgggaggaggttttattaaaggttttatgttttagggattttagggtgagggtaaattggttttaattttaaaatttatttttttttttttttttcgttttattttgttcgtatttagtttttaaatggaagattatgggtttttagttaggagaaatggattgatttaagtaagttttatttattagatgttcgtaggttggggtagtttcggcggttttttttttttttgttagttagtgttaattttcgtggtttttaagttttcgttgttattttgttttattttttggggagagtttggttttgttgtggatggaattcggaggattttagttttttgagtagtttttttttttttttggtgttgattagaggtttttgggtagtattagttaaagtaagagcgtatttattttggagtcgtttacgattaggacgtagagaagtaggcgcgttagtagggtttttatggtggcgaggtcggggcgttagacggcggttttgtaaaggaaggagaagttagggtaagaggcggaggaacgggaaggtaggttaggcgggcgattgtagcgtaggggagatgttcgcggtgattaggttttttagttgttttttttttttttgggtttcggatttcgggtagtttggatcggtattcgcgggggacgttcgggacggggcgttttgatttcgtgtagtcgtcggggagtttagggagttcgggtagtttagggcgggggaggtagacgttcgggagttggggtcgtcgcgtattcggttcggggattttaggatcgcggtatttatcggtggttgcggtaggagggcgcgagtcggcgttgcggggataggtggattttggttcgggtttcggggttgcggttttcgtattgtgttgcgattcgcggcgtttgttttatattagggttcgtttcggcgtcgtttttttttttttcgttcggtttttttttttgttttgtagcgtttagcgattcggatttcgcgtgttttcgtaacgtttataaagatttgggggaagcgcgatttttagcggaggggatttaatagcgtttggattgaggaatcgagaggtttgtaaatttttcgtgtttttttttatgtatttggtcgggggtttgttttagtgtaaggagttttcgaattgtagagaggagagaaggcgtataggagattttttatttcgtttagttttgaagttttttggggttttttaattagtttttttgtaattttttttcgttgggttttaatttgtttaagattgttttagatttttttgttcgtagttgatggagttgtgaagtttttattaacgcgataaatgtacgagatatatttttttagaagtatagatagaaaaatttttgtttgtaggggttttttttgtgcgtttgtttagtggtagtttttagatattattaatataattagtggatggaataaagtcgggtttattgttttcggtagtaagggggtttgtttgatggtgttattagagggggaaaggtaaggttagattattgaaaatttgtagtttggtttaaagttcgtttttgatagggtttgataaggattgggttaggtgtcgtgatatgatgttataggattgtgggaataaagttttagggtataaattgttggtgttttttattgaagtgttaacgggttttttgggaagtttttataatgagtaatttatttatttgtgtaggtaagaataaaagtaaagataatggaaatatgtagatagttttaattgtggaggttttggagggtgtggaagttttgtttttatttttgagtagaggaattgggagattggaggataaaataagaggaagatttattttttattgtttgtttttttatatttttaatattttaaaaagtatatttttgtatagtttattttaaaaagataattatgtattttttaatgtatgtgtatttagtgttttattttattatagagttttgtttattttatttagatagaaataattgtttattaaataaaattgttttttagaaaaatagattatgtgtaaatgattgtatttattttttttgtttgaggataagtagatatttgtgtatatatatatatatatatacgtatttttgggtatatttggaggaatatagtagggattttgtgattttgttatttttattttttttttttagtgttaggaattagggtttggggttattttgaatttagtaggattcgtttttttagtgggaaggaggaggttgagttttagtaatttattagcggttttgggtttttttttagtttaggtttgtagtatttttttgttttgtaaatttggattttgggtttgggtttatttgagagtgatagaaggaaggtagggagagtgttaggaaggtaggaaggaggaaggtttttttgttttgttttagtcgagggtttagggtgttagttgtttgttggggaaagtataagttagttttttagtttttgggaggtaggtgatttattgttttttggagagatttttgtgtttgttgagttgttagttttttaggggatagattgagttagcgatgttataggttttagagttaa

SEQ ID NO: 238 - DNA, 6001 bp, Artificial Sequence
  chemically treated genomic DNA (Homo sapiens)
aaatttataggtgttggtgttatagaggaagagattattttttttgttattataattttaaatttaaagagaatattttagttattaaaatattttatagatttttaataaaaaaaagtattattttgaagttttaaaatatttgttttaaattttaaatttaataattatagttgtattgtaaggttattgtttattgataattttaaaatttagttaagtgattaatattcgtttttattttttataatttttttttagttaatttttttttagtatttttttttgatagtgttattttttaaagtttgcgttaatattgatagtggtgaatgaaagtttaatatttgttttttgttttttttttatttttattttttgtttattaggtggataatatttatgattataaaattttatattttggaaaagagttagtgatgatttttgaatatttttttattatttttttatttttaattgtttttttgttttaacgattgaaataattttttatttgaaatgtatttagataaagaggaaataaagttttaataataaagataaataggtatagtgttttttgtgatggtttgtttggtttaaatgaagattgattatttttaagttaataggggtggaagcggggtgttaagtttttgataatttatttgtaaaattagtttattttttttagtttatgtagttttttttaaaatatttggtaaatatgtaattttttgattgtaaatgttaattttatatttaagttagttattttttaaaataatgtaagggttaggaatgaagtaaattagtttgtgttggattataaagttattaatatttttaaaaattgtttttgtaggtttataattattattataataaagtatttaaaaagtgattaggtaatagtaaagtgaaatttatttttttaaaaataatatatatgtacgtatgaattaagaagttatagaaatatgttgagttttattaaaatgttaaatttagaaattgttaaaaaagagaataatttattgatttaaatttaatagggttgtatattttaatttgtttttgtaaaggataaattagaatgatgtataataattttttttttggtatttatattagtaataattaggaattatataggtttttattttgagttatagttggttatttttttttttttaaagttatatatattttagtttatatatatttttgaaagatattttatttagagttagatttaattatagtaaaattatatttatagaagatgaaaaattatatatatatttgttaaaattagaatagattatatttaggggataatatttaggtatgttaacggagtttaaaatgttaaggaaattatattataattttgtttagtatattataggttgttaaatcgaaatgttatgttagttaggagtgtagtaatttttattttttggttttatttaattaggaagttttagtagagcgaagtttgttaagcgttcgtcgttagaatttgaaggaattcgagcgagtaagaagagtgtttgatttattttatagaagtttgtttagaaatggaggagttagcgtttattgaagtcggtttcgttttcggttcgtttatatggagtttgattagttttagttatgtttatttcggtttgggagattcgtaaagtgtttttttttttaatttttttgtattattttgaagtttagggaagtaaagagaggggtatatttggattgtaaaattaatgttttttgtcgtttaggagagaagggaatgagagagagagagagatagatagatagagagagagagagagagagagagagagagagagagagagagagagaaattttattgaaatttagtttttttagaatttgtgtgatttggtttttaacgggagattagtgcgattttatggtatttttgttaggaattagcgatttttttgtagttattatttgatttattgttttttcgtttatttttttttataaagttattttttttttattttagtaagatttttttttttaatgatgataaagtttttgttttagtgttttttttaggattggtgtttttttaaaatagtgaatttagaaaattatttcgtttaatattttttaaaattttcgtagttttaatgtaagcgtaagtatgtaaaggttttttgttatatttgtattttttgtttattttagaattattttttattttcgggtttgtaatagttttttttgtttttttggatagaggtgggtggtattaggggtttagggtagtaggaggtgaggggttgaggaggcgcgttagggtaggttggtttgtgttggatacgcgtgtttttttgcggagttaaagggtcggggacgggggttttggatttattagagtaattttagtcggtgggcgtttggtagttatttaaggaggtagggaaagtagcgagttttatcgggcgggttacgatgagtagtatgacgggtagtagtagtagttagtaaaagttttcgtaaagtgtttagttgttgtattgtcgcggggatttttatagtattatgattagttcgtgtaattttgtagtagtaaacggttttcgaggaatataggatcgcgggggtcgggtagcgggttattgagtatttcgcggacggcggtagtagaggcggcggcggtggtagtggtattcggcggggaagtagtagttaaattcgcgtatgatttcgagagttttagtaatatttagggattgggtttagtttcggagcgagagggtcgttcgttgagaagttgcgtcggagacgcgggaagttgttgttataaggagggagttttgggaagtcggaggataggaggagacgggagtttaggggtagacgagtggagttcgaggaggtagggtggagggagagttaaggcgtttcgtagttcggtagtcgtttttcgagttttgtcgttcgtatttttttggcgtttgggaagtagtaggtttttagttcgttcggggttacgtgggaagaggtagtcgggttttgattggtggagtaggatgtaggtttcgggagggaggggtcgacgaggaggtgtaaggatgtaaggaggaggcggtcgcggaagttatagatgggttcgttcgttaggcgttggttcgagtggggttaggcggggatggtttaaatgagaagttcgggttttagggtgggttattcgtatatttatatattattcgttttatttttcgttttaggacgttttttatcgaaggcggggttcggattagcgtttttttttcgcgcgtgatttcgggtcgcgagtgcgggtcgcggttgggtggcgttttttcgagttggagatggtgggggcggaggtgttagaggagtagtagtagtagggtagagaggggcgagtcggcgcgggagagggcgttttgttggcgatcggcgttttagcgtgcgggagcgcgtcgtttaggttgtagggggatgtaggttgggaatgtcgcggcggagaggttagggacgtttttttagggatttataggaaagagggtgagaggcgatggtgttagaatcgtttttgtcgatttggaagtaatagtagtattttttataagagcgtgtaattttaaggttgttcgtcgaggtagtttagttatttcggtaggcgttttttttttttttttttttttttttttttttttttaggtttttcgtagtttcgatttagtttaagcgttcgtaggtttgaatttttttttttattattcgtttttttttagttcgtagtttattagtgtgtttatttgggaggtgcggttagatgtgtttggaaggttagattggtcgggataagtggtttgagagaaagagaaaggtttttttgtatacgtcgcgggtgggttgtcgggagtatcggtcgggtagcggcgttcgggaaggggagagcgggttttatttgttggtttaggtagtgattttgcgttttttattcgggtttttgtcggatggtcggtgatttggggcgacgagagaaggtttaattcggtaggagtttttggttttgcgcgttttttttattttttttagcgggaagggtaaacggtatagcgggattcgtttttcgtttgttgtattttttaggtagttagatatattttttagtttaatggaattttagtcgttagtaacgggattaagagttttcggggataagggtggagaggaatattttttttttatgatcggggttattattgtagttttagtgttttggatgttttatagggaagagttttttttttggtgtgtgattatttagtgatttttgtttttgtttttgtttatttttttttcgttttttttttttatttttttttgttattttttttttttttttttttttcgtttttaaaagttttcggattttttttttttttatttaaattttttttttgtgtttttttttttgtgttttttgaatttaggagagtatttgataatatttaataggtaattagtgtttatttttaattatttaaaagaggtatttatatattttgaaaacgggattatttattttttgtagatattagtagaaaaataaattgtattcgagtaatttttttaagtattttaatttttaatttttttttatttttttgttttttaattttttttttgagagatgtgatcgtgtagtattttagtgttttaacgaaattttttttttttttttgtgtgaaatttatttttttattttatattttcgttttcgttcgagattgtttttttttttttttatttttaaagatttttgaattttagtgttttttatttttggtaattaagtagtagattttagtattttagtcggtggtatttcgttttttatcgacgaagattttattaaaatagattaattagattagacgttggaggtattagaaaatcggtttttagatagagtagttaaattttttaaggaaatagaatatttattagatagagttgttaattaatattgtaaaataaggaattagaaatttttttcgttataggtttttagtagagaaggtaatataaatatagattaagatttaataattttatagtagagaatgagaatatgttattttttatagtaaggttggtgtggtaattaattaggtttatgaaaataagttatgtttgaaattaaaggtaaagtttttaaaagtgtttatgtagtaattatgataatgaaataggatttgttaggattttagagtttggttatgtaagtagaattttagagaattttttagtagaggaaaattgtttttgaattttttgttaagtaaatttttggtatattttttaataatatatgttttttttaagacgttttgttaaaagtaagttaaaattttaaaggagttaattattggttgtaattggttaataaatgcggttgtttttatagaggttttttaaattattaaatagtttgaagtaaagtttttttaatgggaatgttgtaattttgttgtatttattttgtatttagtgttatagtgttattaagaaataaattttgaaattggtaagtattattaagtggtagaagaatattatttattgagtagagaattgtattattgaatatgtaaataaaaatatatatattatttagatttgttattaggtattaaagaagtagataagattgtattagtaattggattagtgttttaatttttttttagtaaggtaaaattagtttatttattagaattaaatttaagtttatgaattgtattttgtattgcgtattatatgattgttagtaatatgatataattatattatgtatttgtaaaatttttattttaaaatattatattatatttatttttaatttttttgagttagaatattttatttgtggtatatatattttagaattgatgtagaggagtagagtttagttgtt

SEQ ID NO: 239 - DNA, 6001 bp, Artificial Sequence
  chemically treated genomic DNA (Homo sapiens)
aataattggattttgtttttttgtattaattttagagtgtatatgttataaataaagtgttttagtttaagaagattgaaagtaaatatggtatagtattttaaaataagaattttgtaaatatatggtatgattgtgttatattattagtaattatatgatacgtaatgtaaagtatagtttatagatttaaatttaattttaataagtaaattgattttgttttgttggggaaaagttaaagtattaatttaattgttaatgtagttttgtttatttttttggtatttagtgataagtttaaataatgtatatatttttatttatatatttagtaatataattttttgtttaatgagtgatgtttttttgttatttggtggtgtttgttagttttagaatttgttttttggtggtattataatattaagtatagagtaagtgtaataaaattgtagtatttttattgaaaaggttttgttttaaattgtttaataatttaaaggatttttgtggaagtaatcgtatttgttaattagttataattagtaattaatttttttggagttttaatttatttttggtaaaacgttttaggaagagtatatattattagaaagtatgttaaaaatttatttagtagaaaatttaaaaatagtttttttttgttaagaggttttttaaaattttatttatatagttaaattttgaaattttagtaggttttgttttattattataattattgtataaatatttttaaggattttgtttttagttttaagtatgatttatttttataagtttgattagttattatattagttttgttatggaaaatgatatgtttttattttttgttgtagagttgttaaattttgatttatatttatgttgttttttttgttgaaagtttgtagcgaaagaaatttttaattttttgttttgtaatattagttggtagttttatttaatgggtattttgtttttttaaagaatttagttgttttgtttagaagtcgattttttgatgtttttaacgtttggtttaattgatttgttttaatggagttttcgtcggtgaggagcgagatgttatcgattagaatgttgggatttgttgtttaattgttaggagtgagagatattgagatttagaaatttttggaggtgggaggggagagggatagtttcggacggaggcggagatgtaagataaagggatggattttatataggaaaaaaaaaaagatttcgttgaggtattgaggtgttgtacgattatattttttaaaggagaagttaaaaagtaaggaagtgggaggaggttggaggttaaagtatttaaaaggattattcgggtataatttgtttttttgttggtgtttgtaaaggatagatagtttcgtttttaaagtatatgaatgttttttttaagtgattgggaatggatattaattgtttgttaaatgttattaaatgtttttttaaatttaggggatatagaaagaggggtataaaaggagaatttaaatagaaaaagggaggattcggaggtttttgaaagcggggggagaagaaggaggagggataatagagaggaatagagaaggagagcggagagaagataaataaaaataaaaataggaattattgaataattatatattaaaaagaaagtttttttttatggggtatttaaaatattgagattgtaatagtgatttcggttatggaagaaagatgtttttttttatttttgttttcgaaagtttttggtttcgttattggcgattaaaattttattaggttaaagagtgtgtttaattgtttgaagaatgtagtagacggaaggcgggtttcgttatgtcgtttgtttttttcgttggagagaatgaaagaaacgcgtagagttagagatttttgtcgagttagattttttttcgtcgttttaggttatcggttattcggtaaagattcgagtaaggaacgtagggttattgtttgggttaataaatggagttcgttttttttttttcggacgtcgttgttcggtcgatgttttcggtaatttattcgcggcgtatgtagaggagttttttttttttttttagattatttgtttcgattaatttgattttttaaatatatttgatcgtattttttaggtggatatattaataggttacgggttggagaggagcgggtgatgaggagagggatttaaatttgcgaacgtttgggttgggtcggagttgcggggggtttgggaggagagaggggagaagagagaaggaaggagagcgtttgtcgggatggttgagttgtttcggcgagtagttttggggttgtacgtttttgtgggagatgttgttgttgtttttaggtcggtaagagcggttttaatattatcgttttttatttttttttttgtaaatttttagagaaacgtttttggttttttcgtcgcgatatttttagtttgtatttttttatagtttaggcggcgcgttttcgtacgttggagcgtcggtcgttagtaggacgttttttttcgcgtcgattcgtttttttttgttttgttgttgttgtttttttgatattttcgtttttattatttttagttcggagagacgttatttagtcgcggttcgtattcgcggttcggggttacgcgcggaagaggggcgttagttcggatttcgttttcggtagggggcgttttggagcggagagtgaggcgaatggtatatgagtgtgcgggtagtttattttgaagttcgagttttttatttgagttattttcgtttagttttattcgggttagcgtttggcgagcgagtttatttgtggttttcgcggtcgttttttttttgtatttttgtattttttcgtcgatttttttttttcgggatttgtattttgttttattaattagagttcgattgtttttttttacgtgatttcgggcgggttgaggatttgttgttttttaaacgttagagggatgcgggcggtagagttcgagaggcggttgtcgggttgcggggcgttttgattttttttttattttgttttttcgggttttattcgtttgtttttggattttcgtttttttttgtttttcggttttttagagttttttttttatggtagtagtttttcgcgttttcggcgtagttttttagcggacgattttttcgtttcggggttgagtttagtttttggatgttgttgaaattttcgagattatgcgcgggtttggttgttgttttttcgtcgggtgttattgttatcgtcgtcgtttttgttgtcgtcgttcgcgggatgtttagtagttcgttgttcggttttcgcgattttgtgtttttcggaagtcgtttgttgttgtagagttgtacgaattagttatggtgttgtgggagttttcgcggtagtgtagtagttggatattttgcgagggtttttgttggttgttgttgttgttcgttatgttatttatcgtagttcgttcggtgaagttcgttgttttttttatttttttaagtgattgttaaacgtttatcggttggaattgttttggtaagtttagaattttcgttttcgattttttaatttcgtagaagaatacgcgtatttagtatagattagtttattttagcgcgtttttttagttttttattttttattgttttagatttttaatattatttatttttatttagagaaataaggggaattgttgtaggttcgggggtgaggggtggttttgggatgggtagaaagtgtaggtgtagtaggaaatttttgtatgtttgcgtttatattggagttgcgaggattttgagaaatattaaacgggatggttttttgggtttattgttttgaaagagtattaattttaggggaaatattgaaatagaagttttgttattattaaagaaaaaagttttattaggatgaggaagaaataattttatgagaaagaatgagcgagaaagtaataaattaaatggtgattgtaggggaatcgttgatttttggtaaaggtgttatgaggtcgtattggtttttcgttgaagattaggttatatagattttagaggagttgggttttaatagaatttttttttttttttttttttttttttttttttttttttttttttttttatttatttattttttttttttttttattttttttttttttaggcggtaaaagatattggttttgtagtttagatatgtttttttttttgtttttttaagttttaaggtagtataggggagttgagaaaaagaatattttgcgggttttttaggtcggagtgggtatgattgaggttggttaggttttatgtaggcgagtcgagggcggaatcgattttagtgggcgttgatttttttatttttggataggtttttgtggagtgggttaggtattttttttgttcgttcgggtttttttagattttgacggcgaacgtttggtaggtttcgttttgttgaagttttttaattaaatagggttagaggatgggagttgttgtatttttagttggtatagtatttcggtttgatagtttgtagtatattgggtagaattgtggtgtaatttttttggtattttaaatttcgttaatatgtttgggtattgttttttaggtgtggtttgttttagttttagtaagtgtgtatgtaattttttattttttgtgaatataattttgttgtagttaaatttggttttgaataaagtgttttttaaagatgtatataagttgaagtgtatgtaattttagagaggagggaatgattaattgtaatttagggtgaaagtttgtatagtttttagttattattgatgtaaatgttaaaaggaaaattattatgtattattttaatttattttttataaagataagttgagatatgtaattttattagatttgggttaatagattgtttttttttttggtagtttttaaatttggtattttaataaaatttaatatgtttttataattttttgatttatgcgtatatgtgtgttgtttttgaaagaataagttttattttgttattgtttaattattttttagatgttttattatggtaataattatgagtttgtaaaaataatttttggaaatgttgatggttttgtagtttaatatagattggtttgttttatttttagtttttgtattgttttaggaaataattaatttaaatgtgaagttgatatttgtaattaagaaattatatatttattagatattttaaaggggattgtataaattaaagagaataaattggttttgtagataggttgttaagaatttggtatttcgtttttatttttgttaatttagaggtgattaatttttatttgagttaaatagattattatagaaaatattgtgtttgtttatttttattattgaggttttgttttttttttgtttggatatattttaaataaggggttgttttagtcgttgaagtaaaagaataattaaagatggggaaatggtaaaagggtatttagagattattattagtttttttttaaaatgtggagttttgtggttataaatattgtttatttaatgagtaaaaaataaaaataaaaaaaaaataggaagtaaatgttaagtttttatttattattgttagtattaacgtaagttttaaaaaatagtattattagaaaaggatattaaaggagaattgattagaaaagaattgtggaaaatggaaacgaatattgattatttaattagattttgaggttattagtagatagtgattttgtagtatagttatagttgttggatttaaaatttaggataagtattttaaagttttaaagtagtgtttttttttgttaaaaatttgtaagatgttttaatgattggagtgttttttttgaatttgaggttatgatgatagagaaaatgatttttttttttgtgatattaatatttgtaaattt

SEQ ID NO: 240 - DNA, 7001 bp, Artificial Sequence
  chemically treated genomic DNA (Homo sapiens)
aatgtaatggaaaaagagagattgtaaagttagaaggtttaggaattgttttttgattaggtgtggaaggtaagggaaaattagttttcgaagaagatagtgagattttaatttgggtggttggagagatagtgatgttgggtatagatacggggaagttgagaggaatattatgtttgagaatggtgatttatatttgaataagtttgtaatgtttagtagatcgttggaaaagtggggttggagatatatttaacggaggagttagattaatttttatttttttttatttgagagagttagtaagttacggttggaacgtgtgtgtttagtaggagagggtagggagggaagttaagagagttgggagttcgagtgaagtttttgttaaaggtagaagaggaaagtcggcgtagtatagtatatttttttatttatgtttattaagtttagggataaggtttattaagatgagtttggaagagaatgttggagagaaagtggttaagaaaattgtttttattgaattttttgggttaattttgattgtaagtttttgaataattaaagtttgtgaggagatagttaatttttttattttttttatgttaatagtgaataattgtagatttttttttttttttttttttttttttttgttttttttttttttttttttgaatatttttgtttttttttgggattggtttagagtatgggtggttattgttgatttataggaggtattattgttattaataaagggtaatagtttttttttttaatatttatttatatttagtatttatttttaatattgattatggagagagtttttttgtgtttaaatattgtaatattgggggttttttaaagtataaaaatatatatttgtatgatggtattattaatatttttatggttttttattttttttttgtattggttttaagagttatttataaattttttagtaattgtatagtgttttagggttagagatcggttatttttggtattgtgattagagttatttaatatttaaggtggtgattaatgtttggtaataaagtttttattgggtgttatgtgttttgggattttgagcgtgggtattttaggagtattttagtattgcgtgttagtattatggtcgagagaatagttgagaaagtggttaagaggtggatttatgtgaacgttattgggaaatgagagatttcgtttttaattacggttagtgtaattcgaaagtttaaaattagtttaaaataaaggtatttatttttattttatgtttatattttaggtttttaataatacgtattttttatatgtttatagaaagtagttaattgagttatttatggaaaggtttgtgggtttggttaacgaagtggaggagtattatattttagttggaaatatatttttagaatgttaaaatatttattttaaagtttggttttttggtgtaatcggaggtatggtaatgtttttgtttagagattgggggttagggttagtaaggtatttgatttatatgtattttagaaggtttttattgttaaattatattttttcggaaaaattatttatgttttattttgtaaatttgatatttatatatttttgattggtattttattttagtcgtaagattatgatttatagtaagtttgtttttttttttgtttggggtggtagtagaaagtatagggtattttttagtttttaagggtaggggtaaaggggttggggttttttttttttagtatagttttttttggttgtgttatattgttttttgtgagtagatagtaagtttttttttattttttattgttatttatttagcgttgtgtagtagtttagttgcgtgtttgtcgggaggggttgttaagtgttttgtttattggttgtttttcgaatttttgttattttacgtataaatatatttatatattttttttgtttagtttatatattgagttattcgtatatgcgagtatatttttttttttttttttattttttcggtttttgatttttataagtttatggaatatttttggaaagacgtttttgatttagtagggtaggtttgttttgatttttttttttgtagttttagtattttgagaaagtaatttatttttttggttagtgtttgtattttagtagggagatgaggattgttgttttttatgggggtatgtgtgtgtttttttttttttttaggatttgtaggattttttgtgttatttgtatataatttggtaggtttatattttttaagagttttatgaagtgttttttgtatgtgttttaaaaaggtatttgaaaattgaaagtgtgatttatggaaattaaattatttgtaaaaaattgttttggaaagtaatgattgttggttataaagggaaatatttgcgatgtatttaatgtgtttttaattttttatttgttgataatttatagttattaatgttaaattcgattttggttttagttatatttgtatattgtttaataatggtttatttttgtaagaattagataaaatgtatatttgatataaaatagttaaaaatgtaatttttagtaatagtaagtttggtatttagatagattatgaatatttcgttagatattttgttgggtgtttgggatagtaattaaaataaagtattgatagttgtattagagtttattaggttgtagtaaaggaagtttatttaaaagtataaattatttaagattatagacgtatgatatattttatttattttttgtttttttaatatgtatatatatatatatatatatatatatatatatatatgtgtgtgtgtatgtgcgtgtgtatgtttaatttttaatttagttaaaaatttttttttatttgttttttatttggatatttgattttgtatattttagtttaagtgaatcgagaagatcgagttgtaggattaaaggatagatatgtagaaatgtattttaaaaatttgttagttggattagatcgataatgtaatataattgttaaagttttggttcgtgatttgaggttatgtttggtatgaaaaggttatattttatatttagttttttgaagttttggttgtataattaatttgtggaaggtatgaatatttatgtgcgttttaattaaaggtttttttgaattattttttatatgagaatttttaatgggattaagtatagtattgtggtttaatataaatatataagttaggttgagagaattttagaaggttgtggaagggtttatttattttgggagtattttgtagaggaagaaattgaggttttggtaggttgtatttttttgatggtaaaatgtagttttttttatatgtatattttgaattttcgtttttttttttttagatgttttttgttagtttttttagttgttaaatatagttgtttgtggttggttgcgtatgtaatcgtatattttattttatttgttttatttcggttatagtgtagttttttttagggttattttatgtatatattacgtatttttagttaacgaggagggggaattaaatagaaagagagataaatagagatatatcggagtttggtacggggtatataaggtagtatattagagaaagtcggtttttggattcgtttttcgcgtttattttaagtttagttttttttgggttatttttagtagattttcgtgcgttttcgttttttggtcgtgaaatttagtttttatttagtagcgacgataagtaaagtaaagtttagggaagttgttttttgggatcgttttaaatcgagttgtgtttggagtgatgtttaagttaatgttagggtaaggtaatagtttttggtcgttttttagtatttttgtaatgtatatgagttcgggagattagtatttaaagttggaggttcgggagtttaggagttggcggagggcgttcgttttgggattgtatttgttttcgtcgggtcgttcggttttatcggattcgtaggttttcggggtagggtcggggttagagttcgcgtgtcggcgggatatgcgttgcgtcgtttttaatttcgggttgtgttttttttttaggtggttcgtcggtttttgagttttttgttttgcggggatacggtttgtattttgttcgcggttacggattatgattatgattttttatattaaagtatttgggatggttttattgtattagatttaagggaacgagttggagtttttgaatcgttcgtagtttaagatttttttggagcggtttttgggcgaggtgtatttggatagtagtaagttcgtcgtgtataattatttcgagggcgtcgtttacgagtttaacgtcgcggtcgtcgttaacgcgtaggtttacggttagatcggttttttttacggtttcgggtttgaggttgcggcgttcggttttaacggtttggggggtttttttttatttaatagcgtgttttcgagttcgttgatgttattgtattcgtcgtcgtagttgtcgttttttttgtagttttacggttagtaggtgttttattatttggagaacgagtttagcggttatacggtgcgcgaggtcggttcgtcggtattttataggtattcgcgttcgcgtcgttcgtcggggtggtcgtcgcgttcggtaggagggagggagggagggagggagaagggagagtttagggagttgcgggagtcgcgggacgcgcgattcgagggtgcgcgtagggagttcggggcgcgcggtttagttcgggggttttgcgtgtagttcgcgttgcgtttagagttaagttttttcgtcgggtagttgaaaaaaacgtattttttatttatttatcgttcgtgcgagaggtagattcgaaagttcgggttttttaataaaatatacgttggaaaattagataaagtagtagttatttgtgggggaaaatatttttaggtaaataaatacggggcgttttgagttatttgggaaggtttcgtttttggtatttaaagttgggggtgtttggagttagtagagtttagtagagttttatttatttttttaatgtttttgtttaatgtgttttttaaatttttttttatttagattatttgattggaaatatgttagttatgatgatgattttttgggaagcgatttttgttattcgttttttttttttttttattttacgttttggggttttagagagcgattgggagttgaatgggtttgatttcggagttagttggttgagttcgcgttggagcggattgttggtatgtgatttttgatagtcggaaatttgtaggtgtttcgcgagtttaaaataagttatatggaagtataagtgtttaaaaataattttttgttagtttagtgataagtttgttttattcggggagaatgtttcggagtggcgtgcgggttagttagggtttgcgtttcgtagttattgtggaaggagcgcggtcggtttaggatataggagattattttgtgattttaatggcgaaggttgtgtgtttttattttaatttttttttttataagaattgttttttttttttttttttttttttttatttttttttgtttagtttttttttttgttttttgttttttgtttttttgatgggtttgtagagggattaggtgggcgtttttggtgaatatttttttaggtggttataggataggtgtatttcggattgggtttggaagttttagggcgttatatggttgggttttgaattaggtattttttaattgtatattggtattcggattggtgtttttatatttttttgttttgtaagtcgtggattagtttttgtttagtattttgtttttagggatatttatagtagaaggaaggggattaaagtgtagtttggttttagaggatattgaagggtagattttgggggtatttagtgtgtatttttagtcgttttggagaaatttagagtattttatagttacgtagatttaagttgtttttatttaaaagataaataatgaataaaatttttaaaggttggtatattttaaattaattttatttgttttaatttagggttaaaatagagaaaaaggattttttttgtttatttttttttttttaaatggaagaataaagtatagcgattaagtttaattttatataatatttaaaattgtttgatgtgaaggaaggtattggtatgatgtgaattttataattttatgatggattttagaaattatttttttttttatttaatttttagtttttttattgtaaattaatgttgttgaattttaatgggtattaatgagattgttttttggtagattatttattgttttgttaataattataaagtgaatttggttaaatatagaggggatcgtattttatttaaaattgtttattattttagtgataagtggtattagtgtaatatgttttattttatattttttgtattatatgatatttaaatatttttagaataataaaaaaagagataaggaatttaaaaattaaaaaaaaaatttgtataaatgggattttgtgtggaaatttagttttagaatgattttttttgtgttttatttttcggattatttttttttttttgttagaattttgtttgttattatttagtaaggaaaagaagtatttatgtaagttttttatatggatagatattatttagtatttttttttttttagtttttttgtttaaatgattttgggtataaaggaaaggattgattgggtttttttaggaaattttaagttttttaagtagtttttaaaagttttggggttgaaagtagtgtttttaaattgtttgttatgatttagagggttatgaatttagtttagtgagtttagaatattttttaaaaggattaaaatggaaaggaatataatagaaaatattagagtgtatggtatttcgtaaggataagttttgt

SEQ ID NO: 241 - DNA, 7001 bp, Artificial Sequence
  chemically treated genomic DNA (Homo sapiens)
ataaaatttatttttacgaaatattatgtattttgatattttttattatatttttttttattttagtttttttaaaaaatattttagatttattaaattgagtttatgattttttgggttatgataagtagtttgaaaatattgtttttagttttaaaatttttgagaattatttaagaaatttaaagttttttaaaagagtttaattaatttttttttttatatttagagttatttaagtagaaaaattgagaggggaaaaatattaaataatatttgtttatatgaagaatttgtatagatgttttttttttttgttggataataataggtagaattttaataaaagaggaaagataattcgggaaataaaatataggaaaaattattttaaaattgaatttttatatagagttttatttgtgtaagttttttttttaatttttaagttttttgtttttttttttattattttaagagtgtttgaatattatgtaatgtagaaagtgtaagatagggtatattatattgatattatttattattgggatgatgaataattttgaataagatgcgattttttttgtatttgattaggtttattttgtaattattagtaaggtagtaaataatttattaaggagtagttttattagtgtttattgaaatttagtagtattaatttgtaataaaagaattgaaaattaaatagggaagaaaatggtttttggagtttattataaggttatggaatttatattatattagtgtttttttttatattaagtagttttaaatgttgtgtggaattagatttaatcgttgtattttgtttttttatttaaaaaaaaaaaggtgggtagaagaaattttttttttttgttttaattttaaattaaaataagtaaaattaatttgaaatatgttaatttttaaaagttttgtttattgtttgttttttgagtaaagatagtttggatttgcgtggttgtgggatgttttaaatttttttaaggcggttgaagatgtatattgaatatttttagaatttgttttttagtattttttggggttaaattgtattttagtttttttttttttgttataaatatttttggaaatagaatattgaataaaaattggtttacggtttataaggtagaaagatatagggatattagttcggatattagtgtatagttgggaaatgtttaatttaggatttagttatgtggcgttttgaagtttttaaatttagttcggggtatatttgttttgtggttatttaggaaggtgtttattagaagcgtttatttaatttttttgtaggtttattaggaaaataaaaaataaaaaataaaaggagaaattgggtaagagaaaatgggagggagaggagagggagaaagaataatttttgtagggaaaaaaattaaaatgaggatatataattttcgttattgaagttataaagtggttttttgtgttttggatcggtcgcgttttttttatagtggttgcgaggcgtagattttggttgattcgtacgttatttcggggtatttttttcgggtgggataggtttgttattgggttggtaggagattatttttaagtatttgtgtttttatatggtttgttttaaattcgcgggatatttataaattttcggttgttagaagttatatgttagtaattcgttttagcgcggatttagttagttaatttcgaaattagatttatttaatttttaatcgttttttaaagttttaggacgtggggtggggaggaggggaaagcgggtgataggaatcgttttttagaaagttattattatagttgatatatttttaattaaatagtttagatgaaaggaaatttggggagtatattaaataaaaatattaaaaggataaataaaattttgttgagttttgttaattttaaatatttttaattttaaatgttaagagcgagatttttttaagtgatttaaagcgtttcgtgtttatttgtttggaggtgtttttttttataaataattgttgttttgtttggttttttaacgtgtgttttgttaggaagttcgggttttcgggtttgtttttcgtacggacggtaagtgggtggagagtacgttttttttagttgttcggcgagagaatttgattttgaacgtagcgcgggttgtacgtagaattttcgggttgggtcgcgcgtttcgggttttttgcgcgtattttcgggtcgcgcgtttcgcggttttcgtagttttttaggttttttttttttttttttttttttttttttttttgtcgggcgcggcggttatttcgacgggcggcgcgggcgcgggtatttgtagaatgtcggcgggtcggtttcgcgtatcgtgtagtcgttgggttcgttttttaggtagtagggtatttgttggtcgtggggttgtaggaaaggcgatagttgcggcggcgggtgtagtagtattagcgggttcggagatacgttgttgagtggggggaaattttttaggtcgttggagtcgaacgtcgtagttttagattcggggtcgtaggggaggtcggtttgatcgtagatttgcgcgttggcggcggtcgcggcgttgaattcgtaggcggcgttttcggggtagttgtatacggcgggtttgttgttgtttaggtatatttcgtttaggggtcgttttagggggattttgagttgcggacggtttaggggttttagttcgtttttttggatttgatgtagtagggttattttagatgttttggtgtggagggttatggttatggttcgtggtcgcgggtagggtgtagatcgtgttttcgtagggtagaaggtttagaaatcggcgggttatttggaaaaagagtatagttcgaggttagaggcgacgtagcgtatgtttcgtcgatacgcgagttttggtttcggttttgtttcgggagtttgcgggttcggtgaagtcgggcgattcgacgggagtaagtgtagttttaggacgaacgtttttcgttagtttttgggttttcgggtttttaattttaagtattggtttttcgagtttatatgtattataaaggtgttggaggacggttagggattgttgttttgttttgatattggtttaaatattattttaggtataattcgatttggagcgattttaaagagtagtttttttgaattttattttatttgtcgtcgttgttggatagaggttgagttttacggttagggggcgggggcgtacgaggatttgttaaaggtggtttagggaagattgggtttaaaataaacgcgaaagacggatttaggggtcggttttttttaatgtgttgttttatgtgtttcgtgttagatttcgatatatttttgtttgtttttttttttgtttgatttttttttttcgttggttagaaatacgtagtgtgtatataggatgattttggggaggattatattgtaatcgagatagggtagatagaatggggtgtgcggttgtatacgtagttagttatagatagttatatttagtagttgggggaattgatagggggtatttgaggggaagggggcggagatttagggtatatatataggaagagttgtattttgttattaggagaatgtaatttgttaggattttagtttttttttttgtaaaatgtttttaaagtagatagatttttttataattttttgagatttttttagtttgatttgtgtgtttatgttggattatagtattgtatttggttttattaggaatttttatgtgaaggatgatttagaaaaatttttggttagggcgtatatgggtgtttatgttttttataggttggttatgtaattaaaattttagaaaattgaatataaaatgtgatttttttatattaaatataattttaggttacgaattaaagttttggtaattatgttatattgtcggtttggtttagttaatagatttttaaaatgtatttttgtatgtttattttttagttttataattcgattttttcggtttatttgggttaggatatgtagaattaaatatttagatgaaaaataaatagaaaaaagtttttaattgaattaaaagttaaatatgtatacgtatatatatatatatatatatgtgtatatatatatatatatatatatatatatatattaaggagataaaaaataggtgaagtatattatgcgtttataattttggatagtttatatttttgaataaattttttttgttgtagtttaatagattttgatataattattaatattttgttttaattgttattttaaatatttaatagagtatttgacgaagtgtttatggtttatttaaatgttaagtttattgttattaagagttatatttttgattattttatattaagtatatattttatttaatttttataaaaatagattattgttggataatatgtaaatgtagttgaagttaaaatcgagtttagtattaatgattatagattgttagtaaataaagggttaaaaatatattaggtgtatcgtagatatttttttttatggttagtaattattattttttaaagtaattttttatagatgatttaatttttataaattatatttttaatttttaaatgtttttttaaaatatatgtaaaaagtattttatagggtttttaaaaaatgtgaatttgttaaattatatgtaaatggtataaagaattttataagttttgaaagaaaaaggagatatatatatatttttatggagaatagtaatttttatttttttgttaggatatagatattagttagaaaggtaagttgtttttttaaaatgttaaagttatagagagagaaattaaaataagtttattttgttggattaagaacgtttttttagaaatgttttatgggtttgtagaagttaagggtcgagagagtgagaaggaaggaaggaatgtgttcgtatgtgcgagtggtttagtgtgtgaattaggtagagagagtgtgtggatgtgtttgtgcgtggaatggtagggattcgggaagtagttagtaggtagggtatttggtagtttttttcggtagatacgtagttgggttattgtatagcgttggatgaatggtagtggggagtgaggggagatttgttgtttgtttatagggagtagtgtggtatagttagagaaagttgtattggggaggagaaattttagtttttttgtttttatttttggaggttggaaagtattttatgttttttgttgttattttaagtaagaggaaaaataggtttgttgtgaattatagttttacggttaaaatagaatgttagttaaaagtgtatggatattaagtttataaaataggatatgggtggttttttcgaaagaatataatttaataataaaagttttttgggatatatgtggattaaatgttttattggttttagtttttagtttttgaatagaggtattgttatgttttcgattgtattaggaaattagattttggaataaatgttttggtattttagggatgtgtttttagttgaaatgtaatatttttttatttcgttaattaaatttataaatttttttatgaatagtttagttgattgttttttgtaaatatgtgaaaaatacgtattattaaaagtttaggatatgaatataagataaaggtagatatttttgttttaaattgattttaggttttcgagttgtattgatcgtgattgggaacgaggttttttattttttagtggcgtttatatggatttattttttgattatttttttaattattttttcggttatagtattaatacgtaatattgaggtgtttttagagtgtttacgtttagggttttaggatatatgatatttaatggaggttttgttgttagatattagttattattttggatattaaatgattttaattataatgttaggagtggtcggtttttggttttgggatattatgtagttattgagagatttatgagtggtttttgagattagtataaaaaagaaatagaaagttataaaaatgttaatgatgttattatgtaaatatatgtttttgtgttttgaaagatttttagtattgtagtgtttgagtataggagagttttttttatagttagtattgaaaataaatattggatataaataaatattgaaaagaaagattgttattttttgttggtgatagtggtgttttttgtaggttaataatggttatttatgttttagattagttttagaaaaaagtaagagtatttagggagggaggagagaggaataggggaaaggagaaggaaaggaaaggggatttgtaattgtttattattgatataggaagaataagaaggttagttgtttttttataggttttgattgtttagagatttataattaaagttagtttaagaagtttagtaaaggtagtttttttaattattttttttttagtatttttttttaaatttattttggtgagttttgtttttgggtttggtgagtatgggtgggaaagtatattgtgttacgtcgattttttttttttgtttttggtaaaaattttattcgggtttttagtttttttggtttttttttttatttttttttgttggatatatacgttttagtcgtgatttattggtttttttaggtgaagaagggtaaagattgatttggttttttcgttgaatgtgtttttagttttatttttttagcggtttgttgggtattgtaggtttgtttaaatatgagttattatttttaaatatggtgttttttttaattttttcgtgtttgtgtttagtattattgtttttttagttatttagattaaaattttattgtttttttcgagggttgatttttttttgttttttatatttaattaagaggtaatttttaagttttttagttttataatttttttttttttattgtatt

SEQ ID NO: 242 - DNA, 3501 bp, Artificial Sequence
  chemically treated genomic DNA (Homo sapiens)
taattttgaaaattatttgtagatattttgtaggttttattttaggaataatggttattttttcgggtagttgaagtaaaattaagtttaatgataagtaaatataattattattaaaattttttatttatgtttgttaaagtaatttaagtatgatttgagaaggattttgtattttatatttgagtttttgtggatgaattgtaatttagtttaataggtagataagattgaaaatttaatttaggagtatgtgtttttaataatagttgagttttggttaattttagtggttatattttaattatttatatattgttgagtgtttaaattgtgtttaaagaaggtaaaagttaatttgtaattaatttagttgtttttttgttttatttttaatttttgtatgttatttttttttttttgtttataaatatgttttgattatgaggtatttttggagtttttgaattcgttgtgattttggaagttgttttattcgtaaattatttattatttaattaaattgttttaaatttaattttgttgaagtttttttttaataggtttagaaaaaataatggtaaaaatgaatgaaaatttaataattttggaagtagaaaaggttgggggttttaataagtgtaaatagttttatttttatattttttttatggtaattataatttagtatattatatatatatttttttgtttttcgtattttggtttagggtaaagttttttaaaataggtattgttaattagtgttattaagaaggtttggatgtcgttttgtgggaatattttaaagaggaatgtttaaaaggaaaagggggatgggttgggagaagggtattaggcgggtattttaaaattatttttagggttataggtttaatttatttggttgtggacgttagagtcgttatggtaagaaggaagtaaagttttttgtaataattaaagtttttagaagtagcgtgttttattgtttattagtgcgtcgtgaagtttggtgtttatttatagggttttttttagtattgtttaggtttttcgagtgttttagtatagtagtttggagtttgttggtttggtgattaagatatattttagggaatatgttatgtagtggagtttttttttcggtattgtatagtaaaaggaaagggtcgttgggtgtttgtgggttttgggtagttatagaagttatcgcgttggcggggaggagggggatcgatgcggtttatgtttcgggtagttttattttttttgtttgcgaagggtttttgttcggcgggaggagagaggcgcgttttattcgggtttttttatatttgtcgtcgtttgggtcgatttcgcgggtttcgttcggcgttttagtcgattttcgtttagtttcgggtttatgggcgcggttagtagggcgggttagggcggcggggcgcgatattgggaggaagtgcgggtcgtttgttcgggcgcgttaaggaagttgtttaaaatgaggaagagtcgcgggttcggcggttgaggttatttcggcggcggttggagagcgaggaggagcgggtggtttcgcgttgcgttcgttttcgttttatttggcgtaggtaggtgtggtcgcgttttttattcggtcgggattttttggtaaggagaggaggttacggggaacgacgcgttgtttttatgtttttttttgttttatttttatcggtcgaggtaaaagtgttgaaattatgtgaataaaatataggtgggtttcgttagtttcgtttttgaatttattcgcgttcgggatttagaagttgcgtcgggagagaggggtttaggtttgggcggaggggacggaggttagatcgtgcggaaagtgattcgggtattttagggcgtttaggtttttagggagcgcggaaagtgcggtcgcggttcggttttcgggagacgcgggattgggattaggtatagcgcgaggaagtcgattttggagttagaatatttttttttggttatttatacgaatttattggaaaatgtcgtagtgtttattaaagttatttaaagtagaaatgtttagacgttttatgagtttagataaattttttattataaaaagaaatagtagttgtatttaaataataatttttttgaattattattaaaatttagtataattatttttgtggatatatttttattgttaagtaatttatttagttaatgaatttggagagtaagaaagttttatgtagtaaaatgtaaatttgagttaagagttaagggtgtttttttttgtttgtttgtttgtttttggtaatgtggttttaaaattttaagtttatttaaaaattatataaatgtaatttatttttttgttggaatgtttaaggattagaaagataattggagaagtgagagtttgaatttttttttacgttggaaatagtgttgtaaaatattttttgagttttgtttgatttagtaaagatttagtcgaatttaagtagagtttaaagtattgtagcgtgtagtaaaaaaaaaaaagagttgaagatgttgtgttatatttgatttttggtattaaaaataaaaaaaggaattatttaatttttaagagtttttggaagaaatggaattgattttattatttgatttttttgttttagtagggataaatttattgtttttatataggtagtattttaattaaatgtaattaaatatattgatgttttttttttttttagtgaaagttcgagtagtgtatagatagaattatatttttttaaaaaggtttaaatatatgtaaattattaagtgttttaagtgagaaatttttgttagttgaaattattttattaaattatttttgttttgaacggtatttttgttttaacgtatttagaaaatttttgtattaaaatagaaattgatttgtattattttttgtatttgaagtgtattttaaagtgtatttgaatgagagattataattaaattatttgatttgtgttttatttttttatttttttattttggatttgaaaaggttggatttgaatattaggaaaaaagagatttttttattgagggattgtgggaagatttttttttaagtttttgtatttgaagtgaaatataaaataggattttataatagttttaataattagaaagttttaagttaggataaaaatggggtgtatattttaggtttttattttttttgagagatgaaattggtagaaacgttattttattgttagattttattttagaaatgaattattttgatttttgttaggtttttatttaatattttaaatgtaggtttaatttttttgtttttttttaatggaagattttttagtagaattttatttatttagtatattgtttgtttatggttataatttaatatgtttgtgttaagacgtattttggaatttaagtttttttagaatttggaattaaaatttagaatttaaattttagaat

SEQ ID NO: 243 - DNA, 3501 bp, Artificial Sequence
  chemically treated genomic DNA (Homo sapiens)
gttttgaaatttagattttaaattttaattttaaattttgaaaaagtttgaattttaaaatacgttttggtataagtatattggattataattatgggtaaataatgtgttaaataagtgaagttttattaagaagttttttattaaaaaaaagtagagagattagatttgtatttagaatattaaataggggtttaataaagattagggtgatttatttttaaagtgaaatttagtaataaaataacgtttttattaattttattttttaggaaagataaagatttaaagtatatattttatttttattttagtttaaaattttttagttattaagattattataaaattttattttatattttattttaaatatagaggtttaaaaaaaaatttttttataattttttagtagaaaaatttttttttttttagtgtttaaatttaatttttttaaatttaaggtagaagagtaagaggataagatataaattaagtaatttgattataattttttatttaaatatattttaaagtgtattttaaatataggggataatataaattaatttttgttttaatgtaagagttttttaaatacgttaaaataaaagtgtcgtttagaataaaaatgatttgataaaataattttaattgataaagattttttatttaaaatatttaataatttatatgtatttaagtttttttgagaaaatataattttatttatgtattgttcggatttttattggggagaaggaggatattaatgtatttagttgtatttaattaaaatgttgtttgtgtgaaggtaatgaatttgtttttattaagataaagaagttagatggtagaattaattttattttttttaggaatttttagggattaaatggtttttttttttatttttaatattaagaattagatatggtataatatttttaatttttttttttttttattatacgttgtaatgttttgaattttatttgagttcgattgaatttttgttaagttaggtaaaatttaaaaaatattttgtaatattgtttttaacgtaaaaaaagatttaaatttttatttttttaattgtttttttagtttttgaatattttaataaaagaatggattgtatttatatagtttttaggtgggtttaaggttttggagttatattgttaaaaatagataaatagataaaaagaaatatttttaatttttaatttaaatttatattttattatataaaatttttttgttttttaagtttattggttaagtaaattatttgataatgaaaatgtatttataagagtaattatgttaaattttagtagtggtttagaagggttgttgtttgaatgtaattgttgtttttttttgtagtaaaagatttgtttaagtttataagacgtttggatatttttattttgagtaattttgataaatattgcggtattttttagtggattcgtgtaaatggttaaaggaaaatgttttagttttaagatcgattttttcgcgttgtgtttgattttaatttcgcgtttttcgagggtcgggtcgcgatcgtatttttcgcgttttttgggggtttgggcgttttggggtgttcgggttatttttcgtacggtttgattttcgtttttttcgtttaggtttgagtttttttttttcggcgtagtttttggatttcgagcgcgggtaggtttaggagcgaagttggcggaatttatttgtattttatttatatggttttagtatttttatttcggtcgatgaaggtagaataagaaagggtatgaaagtagcgcgtcgtttttcgtaattttttttttttattagaaagtttcggtcgggtaggggacgcggttatatttatttgcgttaggtgaggcgagggcgggcgtagcgcggggttattcgttttttttcgttttttagtcgtcgtcggggtggttttagtcgtcgggttcgcggtttttttttattttgggtaatttttttaacgcgttcgggtaggcggttcgtatttttttttagtgtcgcgtttcgtcgttttggttcgttttgttgatcgcgtttatgagttcggagttgggcgggaatcggttgaagcgtcgggcgaggttcgcggaatcggtttaggcggcggtaggtgtagaggagttcgggtggggcgcgttttttttttttcgtcggataagggtttttcgtaggtagagaaggtggggttgttcgggatatggatcgtatcggtttttttttttttcgttagcgcggtggtttttgtgattgtttaggatttatagatatttagcggttttttttttttgttatgtagtgtcggggaagagattttattgtatggtatattttttggagtgtattttggttattaaattaataagttttaagttattgtgttggagtattcgggaggtttgggtagtgttgagagggattttgtaggtgaatattagattttacggcgtattagtgggtaatggggtacgttgtttttgaaggttttaattattataaaaggttttgttttttttttattatgacggttttgacgtttataattaaataaattaaatttatagttttaagaatggttttgagatattcgtttgatattttttttttaatttattttttttttttttttggatatttttttttaaaatgtttttataaaacggtatttagatttttttgataatattggttggtagtgtttgttttaaaaagttttattttaagttaaaatgcgagaagtaaaaaaatatatatataatgtgttggattgtaattgttatggagaaaatatagggatgggattatttatatttattggagtttttagttttttttgtttttagggttattggatttttatttatttttgttattattttttttaaatttgttaaaagaaaattttagtagaattaaatttaaagtagtttaattgagtaatgaatgatttgcgaatggggtagtttttagaattatagcggatttagagattttagggatgttttatggttagaatatatttatagataaaaaaagggaagtgatatatagaaattggaggtaaggtagagaaataattggattggttataggttggtttttgttttttttgaatatagtttgaatatttagtagtgtatgaatggttgaagtatggttattgggattggttaagatttagttattgttaaaggtatatatttttaaattaggtttttaattttgtttgtttattaagttaggttatagtttatttataaggatttaaatatagaatatagagttttttttagattatatttaggttgttttaataaatataaatggaagattttgataatggttatatttgtttattattggatttaattttgttttaattattcgaaaaaatagttattgtttttgagatggagtttgtagaatgtttatagatggtttttagagttg

SEQ ID NO: 244 - DNA, 4216 bp, Artificial Sequence
  chemically treated genomic DNA (Homo sapiens)
aggtaataataattatgatgtattaggtttcgggttaaagttattatttgtattaggttattaaatttttaggttaatttattatagttatgagttatttaataatagatatatttaataaattttttgttaggtaattttattattgtgggaatattttagagtggatttatataaatttagatggtttagtttattatatatttaagttatatggtttagtttattgtttttaggttataaatttttatagtatatgattgtattaaatattgaaggtagttgtaatatgagggtaagtattagtgtttttaaagatagaagatggttaggcgcggtggtttacgtttgtaattttagtattttgggaggtttaggcgggtggattatttgaggttaggagtttaagattagtttggcgaatatggtgaaattttatttgtattaaaaatataaaaattagttagtgtcgcggtatttgtttgtagttttagttatttaggaggttgaggtagaagaattatttgaatttgggaggtagaggttggagtgagtttagattaggttattgtattttagtttgggcgatagagggagattttattttaaaataaataaataaataaataaataaaatatagaagatgtatagtaaaaatacggtaattgtttttgtttgtttgttttgagatagggttttgttttgttatgcggattggagtgtagtggtattattaggtttattgtagtttcgatttttttggtttaagtgttttttttattttagttttttgagtatttgggattataggtttacgttattatgtttggttaatttgttttgaattttagtagagatggggttttattgtgttgtttaggtttgttttagttttttggttttaagtaatttttttatattagttttttaaagtgttaagattatagatgttagttattgtatttagttagtaatataattttatgggattatttttatatttgttgttttttgttgatttatatatttttatgtaatgtatgattgttattattattattatttttattttttagatggggaaattgaggtataaagaatttaatttgtataagtttatttgtttagtgatggaataaagatgtgaatttaggtagtttggttttaaagtttatacgtttaataattatattagattattagattgttttttttttttttttttttttttttttgagatggagttttattttgttatttaggttggagtatagtggtgagatttcggtttattgtaatttttgttttttgggtttaagtaatttttttgttttagtttttttagtagttgcgattataggcgttcgttattatatttagttaatttttgtatttttagtagagatggggttttattatgttggttaggttggttttaaatttttgatttttggtgatttttttatttcggttttttaaagtgttgggattataggcgtgagttattacgtttagtttagattgttttatttttgtatttgtatttatttatttatttattttgagatagggttttgttttgtagtttaggttgaagtgtagtggtgtaatttagtttattatagtttttatttatcggggtttaaaggatttttttgttttagtttttggagtagttggggttataggtatgtattattatgtttagttaatttttaaatattttttggtagaagtagggttttattatgttgtttagattggttttaaatttttagttttaagggatttttttgttttggttttttaaagtgttgagattataggtatgagttatgtatttagtttttttttaaaatttttttgagagataagattttgatttgttgtttaggttggagtgtagtggtgagattatagtttattgtagttttaatttttgggtttaagtattagattttttttattatattttattttatacgcgtgtggttttaattttgtttttgttattttttagttgtatgttttaatttaatttgtttggttttgttttttttaatagaaggacggttttggttacgggttatagttagtaacgtttaagtattagggtcggcgagtgttttgtcgtggtacggttttagcgtcgcgttttcgaatttatttgttttttttaacgagagaaggttttagatgagggttgaatttttttcgtttcgtttacggtttttgaacgttgggggaggagtgtatggggaggggcggtttttaaacgggttattgttattaatagagattttaaatatcgtttgttaaaaatattcgattggaggagtataaaagcgtagtcgagtttagcgtttcgtatttttttgagtagacgtttagagtagagttagttagtatgatcgagcgtcgcgtttttttttcgtttttgcggggttttagttgggatttttttcgcgattggtattcgtatagtcgttttttcgattaggttttcgggttgtttcggttgtcggaggagtggtcgtagtggttaggcggtagtagttggttaggttacgtgcgttttttgtttttcgtcgttatcgagagtttcgtagtggtcgcgttcgtttatagtcgcgcgtttagtcggtaatttagtagcggggtttcggagattcggtatattgcggatcgttggcgcgtgtttttggatgttaattatttcgtttcggacgagttgacggttaagattaaggatggcgtggtggagattatcggtgagtttttttgtttttgtaggggagaggaggaggttagtagggcgggtagggtcgggggcgtgcggttgaaacgggggtttcgggggtttggggagttaaacgttggtttagtatcgggaaaaataggatttttgatttttttgtttaggaattgggagtgcgggtcgtttttaagggcgttttttgttttgtaattttagcgttttgggaggtcgagacgggaggatcgtttgaggttaggagtttaagattagtttgggtaatatagcgagacgcgttttttcgtttcgatttcgcgttattataaaaaaaaagtaaataaaaatttttttaaagattatcgatgaagagagaaaatgcgtttttttatagagttttttttttatttatagttttatttttagataagcggggagttttttggcgcggtgttagtttttagtcgttgagtgggcgtgtgcgcggttttaagtgcgtttgcgtattgtttattttttagtttcgcgttttgtttcgttttttttaaaattttgaatcgaagaatttttcggaagtttttgagagtttagatcggcgggtacgtttttatttttaattttttttgttaatttttattagtttgtagttttggttgtttttaagtaggaggtggggtttttggtttagcggggtcgaaaggtagttttttttttcgtagtttgattttttttttttttttaaaggtaagtacgaggagcggtaggacgagtatggttatatttttcggtgttttacgcggaaatatacgtgagttttggcgttaggtcggggtgggtgggtggcgtgggggtggggttagggaagagggtatagggatttattcggtgtgtaatgtaacgtttgttttttttttttgtacgtttaggttgtttttcggtgtggattttatttaagtttttttttttttgttttttgagggtatattgatcgtggaggtttttatgtttaagttagttacgtagtttaacgagattattattttagttattttcgagtcgcgggtttagtttgggggtttagaagttgtaaaattcgatgagattgtcgttaagtaaagttttagttcggatgtttatttttgttgtcgttattggttgtgtttttttcgttatttgtgtgtttttttgatatatttattttttgttttttttaaataaagtttaaagtaattatttgttattggtttaggttttggtgtttgtggaaggaagttttaggtatttgttatttgttggtttttaggagttatttttgtttaggttcgtgttgggttatgtgggtatattggtgtaggttgttggatataggttgatttatatttataaagatagaggttttagggtcgggcgtagtggtttatatttataattttagtattttggggggttgaagtaggaggagt

SEQ ID NO: 245 - DNA, 4216 bp, Artificial Sequence
  chemically treated genomic DNA (Homo sapiens)
attttttttgttttaattttttaaagtgttgggattgtaggtatgagttattgcgttcggttttaagatttttgtttttatggatgtgagttagtttgtgtttagtaatttatattagtgtatttatatggtttagtacgggtttgagtaaagatgatttttgaaagttagtaaatggtaggtgtttgaggtttttttttataaatattagggtttgggttagtgataggtggttgttttgaattttatttgagaaaaatagaagataaatgtattaaaagaatatataggtggcgggggaggtatagttagtggcggtagtaggggtgggtattcgggttaaggttttatttggcggtagttttatcggattttgtagtttttgggtttttaagttgggttcgcgattcgaaggtgattgggatggtgatttcgttggattgcgtggttagtttgggtatgggggtttttacggttagtgtgtttttaggggatagggaggaggaaatttgggtggggtttatatcggggggtagtttggacgtgtagagaggaaaggtaagcgttatattatatatcgggtgggtttttgtgtttttttttttgattttatttttacgttatttatttatttcgatttggcgttaggatttacgtgtattttcgcgtgaagtatcgggagatgtagttatgttcgttttgtcgtttttcgtgtttgtttttggggggaagagggaaattagattgcgggggaggggattgtttttcggtttcgttaggttagaggttttattttttgtttggaagtagttaggattgtaggttggtagggattaatagagggggttggggatgggggcgtgttcgtcggtttgggtttttagaaattttcggaaagtttttcgatttagagttttgggaggaacggagtagggcgcggagttggggagtgagtagtacgtaggcgtatttggagtcgcgtatacgtttatttagcggttagaaattggtatcgcgttagggaatttttcgtttatttggggatggggttgtgggtgggaaggggattttgtagaaaagcgtattttttttttttatcgatgatttttaaaaaaatttttgtttgttttttttttgtaatggcgcggggtcggggcgggggggcgcgtttcgttatgttgtttaggttagttttgaatttttggttttaagcgattttttcgtttcggttttttaaagcgttgggattatagagtagaaagcgtttttagaagcgattcgtatttttaatttttgagtaagggaattaggagttttgtttttttcggtgttgggttaacgtttaattttttaggttttcgggattttcgttttaatcgtacgttttcggttttgttcgttttgttagttttttttttttttttgtaggagtaggggggtttatcggtgatttttattacgttatttttggttttgatcgttagttcgttcggggcgaagtggttgatatttagggatacgcgttagcggttcgtagtgtgtcggattttcgagatttcgttgttgagttgtcggttgagcgcgcggttgtaggcgggcgcggttattgcggggttttcgatggcggcggggggtagggggcgtacgtagtttggttagttgttgtcgtttaattattgcgattattttttcggtagtcggggtagttcgaaggtttggtcgaagaggcggttatgcgggtattagtcgcggaaggggttttagttggggtttcgtaggagcgagaaggggacgcggcgttcggttatgttggttgattttgttttggacgtttgtttagaaaagtgcggggcgttgggttcggttgcgtttttatgtttttttagtcgggtatttttagtaggcggtgtttgaggtttttattaatggtaatgattcgtttgagggtcgtttttttttatgtattttttttttagcgtttaggggtcgtgggcggggcgaagagggtttagtttttatttggaattttttttcgttaaggaaagtaaatgaattcgagagcgcgacgttggagtcgtgttacggtagggtattcgtcggttttggtgtttaagcgttgttggttgtggttcgtggttagggtcgtttttttgttaaggaggatagagttagataggttgggttggggtatataattgagaagtggtagaggtaggattggaattatacgcgtgtgagatagaatgtgataaaaggagtttggtgtttgagtttaggagttgaggttgtagtgagttatgattttattattgtattttagtttaggtaatagattaaagttttgttttttaaaaaaattttaaaaaggggttgggtgtatggtttatgtttgtaattttagtattttgggaggttaaggtagaagggttttttgaggttaggagtttgagattagtttgggtaatatagtgagattttatttttattaaaaaatatttaaaaattagttgggtatggtggtgtatgtttgtggttttagttattttagaggttgaagtaggaggattttttgaatttcggtgagtagaggttgtggtgagttggattgtattattgtattttagtttgggttatagagtaaaattttgttttaaaataagtaaatgaataaatataaatataaaaataaagtagtttgggttgggcgtggtggtttacgtttgtaattttagtattttgggagatcgaggtgggaggattattagaggttaggagtttgagattagtttggttaatatggtgaaattttatttttattaaaaatataaaaattagttgggtgtggtggcgggcgtttgtaatcgtagttgttggggaggttgaggtaggagaattgtttgaatttagaaggtagaggttgtagtgagtcgagattttattattgtattttagtttgggtgatagagtgagattttattttaaaaaaaaaaaaagaaaaaagaaaaaagtaatttagtaatttggtgtggttgttaggcgtgtggattttgaagttagattgtttgaatttatatttttgttttattattaagtagatgaatttgtgtaagttagattttttgtgttttagtttttttatttggaaaatagagatgataatgatggtaatagttatgtattgtataaagatgtgtaagttagtaagggatagtaaatatgaaggtggttttataaaattatattattggttgggtgtagtggttgatatttgtaattttagtattttgggaggttgatgtgggaggattatttgaagttagaaggttggaataagtttgggtaatatagtgagattttatttttattaaaatttagaataaattagttaggtatggtggcgtggatttgtagttttagatatttaggaggttgaggtgggaggagtatttgagttaaggaggtcgaggttgtagtgagtttgatggtgttattgtattttagttcgtatgatagaataagattttgttttaaaataaataaataaaaataattatcgtgtttttattgtatattttttatgttttatttatttatttatttatttattttgagatggagtttttttttgtcgtttaggttggagtgtagtggtttgatttaggtttattttaatttttattttttaggtttaagtgatttttttgttttagttttttgagtagttgggattataggtaagtgtcgcgatattggttaatttttgtatttttagtatagatggggttttattatgttcgttaggttggttttgaatttttgattttaagtaatttattcgtttgggttttttaaagtgttaggattataggcgtgagttatcgcgtttggttattttttatttttagaaatattaatatttatttttatgttgtagttgtttttaatatttggtgtagttatatgttgtagaggtttgtagtttaggagtagtaggttagattatatggtttaggtgtgtagtaggttagattatttaggtttgtgtaagtttattttgagatgtttttataatgatgaaattgtttaataaggaatttgttgaatgtgtttgttattaagtgatttatgattgtaatgggttggtttgaggatttggtgatttaatgtaggtgatgattttggttcggagtttggtatattataattattgttattt

SEQ ID NO: 246 - DNA, 11001 bp, Artificial Sequence
  chemically treated genomic DNA (Homo sapiens)
ttaagttagatgttttttaattatttgtggataggttaggtatattttgagtttaattttattttataggtttaatattttggagttagaaagtttttaggtaaaaagtttgaagggggtttttttatgttattagatggatttttgtatttttagaagattttttatattaggaaagattaaagtattaaggtaattttttttggttttttgggataattttaggttttggtatgagtggtttggaagtttttgttttagttataatgtttatatatttttggaattgttttgtagggtttgttttttagtataattttttttttaagttttattgtagttatagtttattagttttgtttagtgataattaagaaattaagaattatgtatttacgtttatttttttagagttatttttttttaggataaagtttagggttttgttattgggttttgttaggagtcgtagtcgtaggggttgtttattatttaatagttttcgtaagtatattgtgaaggggaagtaatgattagagatagggttagttgtttagtttttgtatgtttaggtgtatgcgtatatatttttatatagggtagggtggggtgggaagtttattttggtcgtgacgtttagcgcgtttaaagagtgtaaatttgcgggggttatttattattaagaattttcgtagtagggttttaatgattttacgtgtttttgtgcgtgatagtatatgtaggtgtttgatagtatttttgggtaggtaaaaggaagtgcggcgtttgatatttgtgtttcgttttgggtttcgtcgggtattttgtaaggagggtggttttttgttggagggtatagagatagggcgtattagttttagttgaattttgatgaagtttgtgtaagaatcgtttttgttttaaagaaatagagaaattaaattttgataataggttttaggtgagatgttagtttatttggggttaggttgggtatgtataaattattgtttgcgtttatttaagataattttagttgtgattttttgagtattaggtatatagttgggtatttgtttttttttacgttttttttttgagtagttaatttattaagtttatgaagaggttgttgttgatttgggtattgtattttttgattttttgtttaattttagtttgagaaaggttaggtgttttttattttataggttcgttttgtaagatgggttagtatggatatagggtttttgaggaatttagggtttttttgaaaaatggtttttggggtagtttttggaaattgattgtttttggttttttgtttttgatgtatatatatatagttggtgtttattttgaatttattattgtttttggttttgtatgttttgggtggataagggaaagatagaattatttggtttttttttgttgtttgtttagggttttagtattgaatgtagttttaaggatattatagaagtaggggtaattgaaggtatatggttaggggttaggaatagttgagggattttgaagagggatttttatttaaagtaaaattaggttgggtgtggtggtttatatttgtaattttagtattttgggaggttaaggtaggaggattatttgatttttaggagtttgagattagtttgggtaatatagtaagattttatttttattaaaaaaagaaaaaaaaaaattagttaggtgtggtggtgtgtttgtagttttaattgtttaggaggttgaggtgggaggatcgtttgagttcgggagattgtagttatagtaagttattatcgtgttattgtattttagtttggggaattgagtgagattttgttttaaaatataaaaaataaaaataggttgggtacgttggtttacgtttgtaattttagtattttgggaggtcgaggcgggtggattatttgaggttaggagtttgagattagtttgattaatatggagaaatttcgtttttattaaaaatataaaattagttaggcgtggtggtatatgtttgtaattttagttatttaggaggttgaggtaggagaattgtttaaattcgggaggtggaggttgtagtgaattgagatcgtgttatcgtattttagtttgggtaataagagcgaaattcggttttaaaaaaaaaaaaaattagtaaaattatattttaattgtatattttgattatagtattttagttgagttggagtgagggtttgttttggagaaggtagtttattttttttttttgtttcggtacggggttatgatttattgtagggtgagaggagtggagagtggtgtatattagtagtttagttattagtggatagagtagtatttggagttagttttttatgttttatatatagtgagaaaaattattgtgatatgatgtttaattttgatttaagttgtataaaaggtagttttaggttaggttttaatttgttagaggtatataggtagttttttggtgggtttttgtatttgtttgtgttgtttggagatttggtttaaagattttttttttttttgagacgaagttttattttgtcgtttaggttgtagtgtagtggttggattttggtttattgtaagttttgttttttgggtttaagcgatttttttgttttagattttcgagtagttgggattataggcgcgtgttataataatattcggttaatttttgtatttttagtagagatgggattttattatattggttaggttggttttgaatttttgattttaagtgattcgtttgtttttattttttaaagtgttgggattataggcgtgaattatcgtattcgatttagagatttttaattcgattatttattttttattttatttagggattggatttttgtcggaagggtggagtgtgggatagggtagttagggttttgaatcgattttttttttttagatttttttggttttattgtattagttttattttttgttgacgttagataggttttagttagaatgcgagtgttatagatatagttaagtttagcgttgattaatattttgttttagaagaatttttataaggttttttgtagaatgattttgtgtttagtttaggagagttagggttttttttgatttcgttttggagtttttttaagtatttaaattatttgatggggataaatggagaggatagatgagggagtagggtggagcgttttagtagaatgttttttatttagaattcgttgttattttgtagttagtaaggatgtggggttaagaattaaggttagggttttataggaaaaaggtaaagggggaggggtgggaatttaagtttatttttttttttaagtatttaaaggttttttggatggagaagagtattggagtaaaaattttagtataaattttattggggatagtgggtaattttgtcgggttagtaaaaataaatggtgtgggttttggaaaatgagggttggaggttgtgaataaagtagtggatgtgtttgtttagtatattaacgggaagaagtatttagatgggaggagtattaggggtaggagaaatgttagatagattttagtgttagggtaagaaggaagattattttgtttgtagaatagggagggtatagggatggtgttaatttgtttttgtgatggttttgagtttttatttaataatgagaaagtttgtttttttttttttttttggatgatttaggagttttgggttgggatgtagtgattttatttttagtttttttttttttggtgatgaatttttttatttttatttagaaaatagatttggattagaggtattgtatagtttttttaggattttaaaggaggaagagtttttttttttgtttttaaagttgtttgttggaagaggattttaatagttattttagtcggatgtatagtaggattatggaattttttttttgtattatagggatttattttttattttattattgtttataaaaattgatggttttttttttgagatagagtttcgttttgttttttaggttggagtgtagtggtgcgattttggtttattgtaatttttgttttttgggtttaagtaattttttgttttagttttttaagtagttgggattataggtgtttgttattataattggttaattttttgtatttttagtcgagacggggttttattattttggttaggttggttttgaatttttgattttatgatttatttatttcggttttttaaagtgttgggattaaaggtgtgagttattgtatttggtttaaaattgatgtttttttttttttttttaatatataatttgggattttttagttttttattttttttttttttttttttttttttttgagatagagttttgtttttttatttaggttggaatgtagtggtttagtttcgatttattgtaatttttgttttttgggtttaagtgatatttttgttttagtttttttagtagttgggattataggtatatattattatggttagataatttttttgtatttttagtatagacggggttttgttatgttggtttggtaggtttcgaatttttggttttaagtgatttgtttgttttggttttttaaaatgttgagattataggtatgagttattaagtttagtttttttttttttttttgagatagagttttattttgttatttaggttggagtgtagtggtacgattttggtttattgtaatttttgtttttcggttgaagtgatttagttttttaagtagttgggattatagttatatattattatgttcggttaatttttgtatgtttagtagagatagggttttattatgttggttaggttgatttcgaatttttgattgtaaatgatttatttgttttggttttttaaagtattggtattagaggtgtgagttatcgtatttggtttttttttttatttttgagatagagttttattttgttatttaggttggagtgtagtggtacgattttggtttattgtaatttttgttttttaggtttaagtgatttttttgttttatttttttaagtagttgggattataggtgtgtattttcgtggttagtttttttttttaattggttagtgttttgtggtttttttatttttttatagtggaaaatggtttaggattgattgatatgaagataagtttaggggtttatatttaatttaatttttgtatttaagttttgggttaagattttggcgtgttgagtattatttattttgtaaggaattttgtaaaattttatttgaagtattatttataattttattttttttatttaaataaggattttcgttttatttttgttaggtatattgagttttatagtttttgttttttttttttggtgtttaggtttggttttttgagtttggtggttatattaatggtatttggtatatagtttttcgataatggggatatttaggaggtttcgagatattttatagttttgggttagtaatttggatttttttttttatttttttaggtattttataatttagttttttttttttttgtgggtaaagtgtttttgaatgtttatggtttaaaataagattttttttttatttatttttaaatttttttttagatttattttagaggaagggaatagaattttttatattttagtagttggtgataggttagaatagggaagaggtgagggtttagttggttttatataggagtgtagatggaggagtaggatttttttttgttttttaagtttttttaaatatattttttaatttttggcgaggatttttttttttttatatttttttttagtttttttaaggagggagtaggagtattcgaacgcggaaatcgaggtgttagtttaaattgttcggtcggttttagttatagttggataatgttcggtttaggtttattataagttatatagttgtttttttcgtgtttaatttgtttgtgatagaaattaagggggtttcggtatttagtatttaggcggtggaatcggggttttacgtacggtttcgcgggtaggttttcggttaggattcgcggggagttacgtagttaggagggtggggttgtttatcgatttaggacgcggtaacggatcggggagggcggagttttagcgatcgttttttttttcgttcgtcggtattttttggtttttatttggtttcggcgcggtttgcgagttagcgaggttcgcgcggtgaagtattgttcgagtttcgagttcgagtttttttggttgtagtagttattgttcgtcgtgttgttttaggttatttcgaaagaaggcgttttcgtttcgtttatagtcgtattcgttcgttttttagttttgcgcgttcgtagtcgttaattatcgtttcggtcgcgtgcgtgcgtgtacgcgtgttagtgtgcgcgtgcgttcgggttagagtcgcgtcgtaatcgttaagattgaaacgtagatcgtcgggatttagtttttgttttattggggtaggaacgtcggggcggggatacgtacgtttcgtttttaggaatgattttatcgtttcggagttttatttatagattttatttattatagggaacgggggcgggtgttagcgttcgggtaagcgtataagagtggtttttggtcggaggcgagggcgggaaggtgcgggaagtgcgcgtgcgcggagtttgggttagtttgggttcgggttcgtttgtagcgggtggagtatttgcggagtcggtaatttaggttttttttttagttttcgcgtagaattagtttttttgtgtcgtcgggaaatcggtaattagaacgttttttgcgcgcggtatttaggtagttttcgagaatgtttgtattgtggtttgtttattttcgttttttttatacgttttcggtttcgcgtttattacgttcgtgtttcgttttatcgcgggtttttagtttaggtttcggggttcgtaatagtttaggtagacgagcgcgcggtagcggtagtggtaggtgaatttgtaatttgtagagaggtttggcggtgaggcggaggagttttaggtcggggaaatgtttcggagattgaagggaagttttagggagagggtcgttgttcgttaggtttcgtaggttcgatttattttagtgggttattttatattgttacgcggattttaatgttggttatttgggcgtttggaaatcggtcggaaggttataggtagagaggtttgtttaatagttggatttttatcgtttagtatagaattttttttttttttattggtaattaaaaaaataataataaaaaattgcgttttgtttttgttatttaggttggagtgtaatggcgcgatttcggtttatcgtaattttcgttttttgggtttaagcgatttttttgttttagttttttgagtatttaggattataggcgttcgttattatgtttagttaatttttgtatttttagtagagacggggttttattatgttagttaggttggttttaaatttttgattttaggtgatttattcgtttcggttttttaaagtgttgggattataggtttgagttatcgtattcggttttttattgggaacgtatatggaatatatttgtttatttatttgaaggaaaaattaaatatttttaatttacgtttgttttgtggttgttatttgtttttattttttttagattaagatattggtttttatatattttaatttttcgtttttatttttttttttatttattttagttaggtttgtttttttttttaggaaattgttcgggatagggtttttagcgatttgtgtattattaaatggaatttagtgttttattttttatttttatttttttagtattatttgaagtttgttttttttgatttttaggggttatatttttttagttttttttttattttttgtagtttttgtttagtttttttgtagattttgatttaatttttatattttacgatgaagtttgggtttagttttgattattggtttggtttgtttatatttatttgttttagatttacggttgaaatattgatttaaatttttagattagatttttcgtgttagtatttttattaggatgtttaaaagacgttttaagtgaatatggttaaaatttaatttttttttttttagttttattgttatatttgtttagttttttttttgtagtaaaaatggttattaggtttttagttattggagataaaagtttaaatttatttttgattttttttttgtttttatttttgataaatatgtttaaattattttgttttttatttttatggttattttatttttttttgagaacgttgtaatgttttagttttgttttttttttttttttttttttttttgagatagagttttattttgtcgttaaggttggagggtagtggtacgatttcggtttattgtaattttcgttttttgtgtttaagtaatttttttattttagtttttcgagtagttgggattataggtattcgttattacgtttggtttatttttttttattttttagtagatatgaggttttattatgttggttaggttggttttgaatttttgattttaggtgatttattcgttttcgtttttcgaagtgttgggattataggtatgagttatcgcgttcggttttttgtttattttttgtattttgttataattttgtgttttttttagttgaatttgtgatgtttttttgtatcggatgagagggtttttatgtatatatagatttgggatattatttatttataagtttttaaataggttagagtagtgatgtttaatttagattttatgttataataatttggggagtttttaaaatttattgatgtttagggtttatttttagtagttgatttaataggtttgcggtgggatttaggttagcggggaggattgtaaaagtatttttggtgattttagttggtgtttatttaggggagagtaatttttgtttgttggcgatttttaggggtgtagaaggattgttgggtgtgtggttgcgtgtatattttagtatttgatttattgggttagaaaagggtgtttgttaaataaagatttaataaaatttttgtttgtagggggtttattaaaggttttaaatttttttaggtttttttttataggtggtaatttttttttattttaaaggttttggagggggttatgagtgtttgagaagaggtaagtttgggaagatggatttcgaggatagtaggtataaatttttttttaagaagggttaaggtattttaaagataagaaatttaaaattagcgtatttttatatataagtagttatttttgtttatttgtggtttagatacgagtggagtgcgataagggataaattattttcgcgtattttttagcgatggggcgaaagtaacggatttagttttcgggagttgttttcgtcgattttttttgtcgcgatttgattcgcggcgattgcgttgttttttggttgtttttttcgttttcgtaggcgcgcggggttattatttacgcgcgtattgtaggtttttgcgtacgacgttttagatgaagtcgttatagaggtcgtattacgtgtgcgtggcgggtttcgcgggttggaagcggtggttacggttagggattagttgtcgtgtggggttgtacgcggtgtttcgcgcgatgcgtagcgcgttggtacgttttagtcgggtgcggttttttttagcgcgtttagcgggtgttagttttcgtagtttaatgagtttaggttttttcgatatggttcggttgggttcgtgtttcgttggttttgggcgttagtaagcgcgggtcgggcggggttatagggcgggtttcgattttagcgttttttttaggatttagattgggcggcgggaaggagttgaggagagtcgcgtaatggaaatttgggtgtagggattgtggggttcgaaggcggggttgggcgcgttttcgtagagtttttttcgttttgtttttttttttttttttcgttttttttttatattttatttcggacggttataacgacggcgatcgtaaagtattacgcggagatattcgtgtttttggaggttagttttattgtgttagaggaagagggtttttatattcggttttggtttttttggttcggtttgttgaagtaatatatttggtttatttattgggtggggtaggaagtttcgagtttttatttggggtgaggaggagggagatcggttagtagttttatcgttcgttttgttttttattgcggagattggggtttcggtagaggttggatcgtgattttgaggtttaggggtgtattttgggtggatttttttggtatgggtggtcggtttttagtaattgtagtttttatttggttttgttattttgggttgttaggatataagtttttttatgttttttttagtgtttgatttggtattttttgtaggtaggtgggtattgaggatggtaatgtatgtgggggatgtgggagtagggtttagaggtttaaggttttaggatatttttatttgtagtaatattatttattttggtatcgtgagtagcgtttagaagtttttgtattgtagtaagtatagcggggtcgttttggagttattgtttttagtatatttagtttgtaggttttagtttatttgggggaaagttaggaaggtttgattggttttggaaggtgggggtattttatttatatttatgttttttgtattttttttattttttttgttatttttataggttttattttcgcgtttgtagtcgtaggttttgttttgaggggttgaatatatgttggagttggtgtttggtaattgtttgttatttgtttttgttttttcgttttagtcgtttttagatttttgggatttagga

SEQ ID NO: 247 - DNA, 11001 bp, Artificial Sequence
  chemically treated genomic DNA (Homo sapiens)
ttttagattttagaaatttgggagcggttggagcgagaaaatagaggtaagtggtaggtaattgttaagtattagttttagtatgtgtttagttttttagagtaggatttgcggttgtaggcgcgaaggtaaggtttgtggaaatggtagggagggtggaggggatgtaggaggtatggatgtgggtggggtgtttttattttttagggttagttagatttttttgatttttttttaggtgggttgagatttataggttggatgtgttagaggtagtggttttagagcggtttcgttgtgtttattgtagtgtagaggtttttaagcgttgtttacgatgttagaatgagtggtattgttgtaggtgagggtattttagaattttggatttttaagttttatttttatattttttatatgtattgttatttttaatatttatttgtttgtagggagtgttaagttaagtattgggaaaagtatggaaagatttgtgttttggtagtttagggtgatagagttaaatgagggttgtagttgttgagggtcgattatttatgttaagggaatttatttagaatgtatttttgaattttaagattacggtttagtttttgtcggagttttagttttcgtagtggagagtagagcgggcggtaaagttgttgatcgattttttttttttttattttaagtgaaggttcgagattttttgttttatttagtgggtaggttaagtgtgttgttttagtaaatcggattaggagggttagggtcggatgtggggattttttttttttagtatagtaaagttggtttttagaaatacgggtattttcgcgtggtgttttgcggtcgtcgtcgttgtggtcgttcggggtggggtgtgaggaggggacgaaggagggaaggaagggtaaggcggggggggttttgcgagagcgcgtttagtttcgttttcgggttttatagtttttgtatttaggtttttattgcgcggttttttttagttttttttcgtcgtttagtttggattttgggggaggcgttgaagtcggggttcgttttgtggtttcgttcggttcgcgtttgttagcgtttaaagttagcgaagtacgggtttaatcgggttatgtcgggggagtttgagtttattgagttgcgggagttggtattcgttgggcgcgttgggaagggtcgtattcggttggagcgtgttaacgcgttgcgtatcgcgcggggtatcgcgtgtaattttatacggtagttggtttttggtcgtggttatcgtttttagttcgcggggttcgttacgtatacgtggtgcgatttttgtggcgattttatttggggcgtcgtgcgtaaaggtttgtagtgcgcgcgtgagtagtggtttcgcgcgtttacgagagcggaaggggtagttaaggggtagcgtagtcgtcgcgggttaagtcgcggtagagggggtcggcggggatagttttcgaggattaggttcgttattttcgttttatcgttgaagagtgcgcgaaaatggtttattttttgtcgtattttattcgtatttgggttatagatgagtagaggtggttgtttatatgtaaaaatacgttgattttaagttttttatttttaaaatgttttggttttttttgagaaagggtttgtgtttattgttttcggagtttatttttttaggtttgtttttttttaaatatttatgattttttttagaatttttagggtgaagggaaattattatttatgggagggagtttggaaaaatttagaatttttggtgggttttttgtaagtaggagttttgttgagtttttatttagtaaatatttttttttgatttagtgaattagatgttaaaatatgtacgtagttatatatttagtagtttttttgtatttttgggaatcgttagtaagtaaaggttgtttttttttgggtagatattagttggaattattaggggtgtttttatagtttttttcgttagtttggattttatcgtagatttgttgaattaattgttgggagtggattttaggtattagtaaattttaaaaattttttaaattattgtaatatggagtttgggttgagtattattgttttggtttatttaggaatttgtggatggatagtgttttaggtttgtgtgtgtatggagatttttttattcggtataagaggatattataaatttagttggggggagtataaagttgtgatagaatgtaaagaatgaataaggggtcgagcgcggtggtttatgtttgtaattttagtatttcggaaggcggaggcgggtggattatttgaggttaggagtttaagattagtttggttaatatggtgaaattttatgtttattaaaaaataaaaaaaaatgagttaggcgtagtggcgggtgtttgtaattttagttattcgggaggttgaggtgggagaattgtttgaatataggaggcggaggttgtagtgagtcgagatcgtgttattgttttttagttttggcgatagagtgagattttgttttaaaaaaaaaaaaaaaaaaaaaaagaataaggttgggatattgtagcgtttttaaagagaaataaagtagttatggagataagaagtaggatgatttgggtatgtttattagaggtagagataagggagaaattaaagataagtttgggtttttgtttttagtaattgggagtttagtggttatttttgttgtaaagaggaagttgggtaagtgtagtagtgaggttgaagaaaagggaattaaattttggttatgtttatttgaaacgttttttagatattttagtgaaggtattggtacggaggatttagtttgagggtttaggttagtgttttagtcgtggatttggggtagatgaatgtagatagattaggttagtgattaggattgagtttagattttatcgtgagatatggaagttgagttagaatttgtaaaggagttgagtaggagttgtagggggtaggaggaaaattgggagagtgtagtttttgggagttaaagggagtaagttttaaatgatgttgagggggtgagaatggagaatggaatattggattttatttggtagtatatagatcgttgaggattttgtttcgggtagttttttggaggaagaggtaagtttggttggagtgggtagaggggagagtgaaggcgaaggattagagtgtatagagattagtgttttggtttgaggggagtagagataggtgataattatagggtagacgtaggttaaaggtgtttagttttttttttaagtaaatgggtagatgtattttatatacgtttttagtgaagggtcgggtgcggtggtttaagtttgtagttttagtattttggaaggtcgaggcgggtggattatttgagattaggagtttgagattagtttggttaatatggtgaaatttcgtttttattaaaaatataaaaattagttgggtatggtggcgggcgtttgtaattttaggtatttaggaggttgaggtagaagaatcgtttgaatttaggaggcggaggttgcggtgagtcgaaatcgcgttattgtattttagtttgggtgataaaagtaagacgtagttttttgttgttgtttttttaattgttaatgaggaaaggggaagttttgtgttaggcgatagagatttaattgttgagtaggtttttttgtttgtggtttttcggtcggtttttagacgtttaggtggttaatattagagttcgcgtagtagtgtgaggtaatttattgagataggtcgggtttgcggagtttggcgagtagcggttttttttttggggtttttttttaattttcgggatattttttcgatttggagttttttcgttttatcgttaggtttttttgtagattgtaagtttatttgttattatcgttgtcgcgcgttcgtttgtttggattgttgcgggtttcgggatttgggttgggaattcgcggtggagcgggatacgaacgtggtgagcgcggggtcgagggcgtatgggaagggcgaggatgggtaggttatagtgtaggtattttcgagggttgtttgggtgtcgcgcgtaaggagcgttttaattgtcgatttttcggcggtatagagaggttaattttgcgcgggggttgggaggggagtttggattgtcggtttcgtaagtattttattcgttgtaagcggattcgggtttaggttgatttaggtttcgcgtacgcgtatttttcgtattttttcgttttcgttttcggttagaggttatttttgtgcgtttgttcggacgttggtattcgttttcgttttttgtggtaggtggggtttgtgagtggagtttcggagcgatgaggttatttttgggggcgaagcgtgcgtgttttcgtttcggcgtttttgttttaatgagataagagttagatttcggcgatttacgttttagttttaacggttgcggcgcggttttggttcgggcgtacgcgtatattgatacgcgtatacgtacgtacgcgatcggggcggtggttggcggttacggacgcgtaggattgggggacgggcgggtacggttatgggcgaggcggaggcgttttttttcgaaatgatttggagtagtacgacgagtagtggttattgtagttaagaggattcggattcggagttcgagtagtattttatcgcgcgaatttcgttagttcgtaggtcgcgtcgggattaggtgggagttagggggtgtcggcgggcgggaggggaagcggtcgttggagtttcgtttttttcggttcgttgtcgcgttttgggtcggtgggtagttttatttttttggttacgtggtttttcgcgggttttggtcggggatttgttcgcggaatcgtgcgtaagatttcgattttatcgtttagatgttgggtgtcggggtttttttggtttttgttatagataggttgaatacggaaaaagtagttgtatggtttgtggtagatttgagtcgggtattatttagttatgattaaagtcgatcgagtagtttggattagtatttcgattttcgcgttcgaatgtttttgttttttttttggggagattaggggaggatgtggagagggaagagttttcgttaggaattgagaagtatgtttaggaaaatttgagaggtagagagagattttgtttttttatttgtatttttgtatggagttagttgagtttttattttttttttgttttggtttgttattagttgttggaatgtggaagattttgttttttttttttagggtggatttggagaaagatttgggaatagataggaaagaagttttgttttggattataagtatttaggagtattttatttataggaagggggaaagttagattataaaatgtttaaagaggtggaaaaagagatttaggttattaatttaggattgtaaggtgtttcggaattttttaggtatttttattatcggagaattgtgtgttagatgttattggtgtgattattaggtttagagaattaggtttaggtattaggaaaaagaaatagggattgtgaagtttagtatgtttggtagaaatggggcggaaatttttatttaagtaaagaaagtggagttgtgagtgatgttttagataaaattttataaaattttttataaaatgggtggtgtttagtacgttaaaattttagtttagagtttgggtgtaagggttgagttgagtgtagatttttgggtttgtttttatgttagttagttttgagttattttttattgtggaaaggtgggaaaattataagatattaattaattgaaaaggagggttagttacggaggtgtatatttgtaattttagttatttgggagggtgaggtagaaggattatttgaatttgggaggtagaggttgtagtgagttaagatcgtgttattgtattttagtttgagtgatagagtgagattttgttttaaaaatagaaaaggaagttaagtacggtggtttatatttttaatgttaatgttttgggaggttaaggtaggtggattatttgtaattaggaattcgaggttagtttggttaatatggtgaaattttatttttattaaatatataaaaattagtcgggtatggtggtgtgtgattgtagttttagttatttgggagattgaattattttaatcgggaggtaaaggttgtagtgagttaagatcgtgttattgtattttaatttgggtgatagggtgaggttttgttttaaaaaaaagaaagaaggttgggtttggtgatttatgtttgtaattttagtattttgggaggttaaggtaggtagattatttgaggttaagagttcgagatttgttaggttaatatagtaaaatttcgtttgtattgaaaatataaaaaaattatttggttatggtggtgtgtgtttgtaattttagttattggggaggttgaggtaggagtattatttgaatttagaagatagaggttgtagtgagtcgagattgggttattgtattttagtttggatgagagagtaagattttgttttaaaaaaaaaaaaaaaaaaaaagaaagaataggaggttgagaagttttaagttatatgttaaaaaaaaagaaaaaaatattagttttaggttaggtgtagtggtttatatttttaattttagtattttggaaagtcgaggtgggtggattatgaggttaggagtttaagattagtttggttaaaatggtgaaatttcgtttcgattaaaaatataaaaaattagttagttgtggtggtaggtatttgtaattttagttatttgggaggttgaagtagagaattgtttgaatttaggaggtagagattgtaatgagttaagatcgtattattgtattttagtttggaaaatagagcgagattttgttttaaaaaaaaaattattagtttttatggatagtggtagagtggagggtgggtttttatggtgtagaagggaaattttatggttttgttgtgtattcgattgggatggttgttgaaatttttttttagtaggtagttttggaaatagaaaaagaaatttttttttttttagaattttggaagggttgtgtagtgtttttaatttaagtttgttttttgagtgaagatagggaggtttattattagaagggaaggggttggaaatgaggttattgtattttagtttagggtttttgggttatttaggaagggaagaaggagtaagtttttttattgttaggtaggagtttagagttattataagaataagttagtattatttttgtgttttttttgttttgtaaataaaatgatttttttttttgttttggtattagagtttgtttggtattttttttgtttttagtattttttttatttgggtattttttttcgttggtgtattgaataaatatatttattgttttatttatagtttttagtttttattttttagggtttatattatttgtttttattaattcgataaggttgtttattgtttttagtaaggtttgtattggggtttttattttagtgtttttttttatttaggagatttttggatatttggggaagaaaatgagtttaaatttttatttttttttttttattttttttttgtaaggttttggttttagtttttagttttatatttttgttggttgtagaatagtagcgggttttgggtaaggagtattttgttaaaacgttttattttgtttttttatttgttttttttatttgtttttattagatggtttaagtgtttaaggggattttagggcggagttagggagaattttggtttttttgggttaggtataagattattttataggaaattttgtgggaatttttttgggataaagtattggttagcgttgagtttagttgtgtttgtgatattcgtattttaattagggtttatttgacgttaataggaagtaaggttgatgtagtggggttaagggagtttgggagaagaaagtcggtttagagttttggttgttttgttttatattttattttttcggtaagaatttagtttttagatgaggtggggagtgagtggtcgagttaaaaatttttgggtcgggtacgatggtttacgtttgtaattttagtattttgggaggtgaaggtaggcggattatttgaggttaggagtttaagattaatttggttaatgtggtgaaattttatttttattaaaaatataaaaattagtcgggtgttgttgtggtacgcgtttgtagttttagttattcgggagtttgaggtaggagaatcgtttgaatttaggaggtagaatttgtagtgagttaagatttagttattgtattatagtttgggcgatagagtgaggtttcgttttaaaaaaaaaaaaaatttttgggttaaatttttagatagtataggtaggtgtagaaatttattaggaagttgtttgtgtatttttggtagattggagtttggtttaaagttgttttttatgtagtttgggttaaggttaaatattatgttatagtgattttttttattatgtgtgagatatggagaattggttttaagtattattttgtttattggtggttggattattgatgtgtattattttttattttttttattttgtagtgggttatggtttcgtgtcggggtagaggagaaaaatgggttgttttttttaggataaatttttattttaatttaattagggtgttgtgattagaatgtgtaattgaggtgtgattttattgattttttttttttttgagatcgagtttcgtttttgttgtttaggttggagtgcgatggtacgattttagtttattgtaatttttatttttcgagtttgagtaatttttttgttttagttttttaagtagttgggattataggtatgtgttattacgtttggttaattttgtatttttagtagagacggggtttttttatgttggttaggttggttttaaatttttgattttaggtgatttattcgtttcggttttttaaagtgttagaattataggcgtgagttaacgtgtttagtttgtttttgttttttgtgttttgaagtagggttttatttagttttttaggttggagtgtagtgatacgataatagtttattgtagttgtaatttttcgggtttaaacgatttttttattttagttttttgaatagttgggattataggtatattattatatttggttaatttttttttttttttttttagtagagatgaggttttgttatgttgtttaagttggttttaaatttttgaggattaagtgatttttttattttagttttttaaaatgttgggattgtagatgtgagttattatatttagtttgattttattttaaatgagagtttttttttagagttttttagttgtttttggtttttggttatgtgtttttagttgtttttgtttttgtggtatttttaaggttatatttagtgttgaggttttaggtaggtagtagagagaagttaaatgattttgttttttttttatttatttagagtatgtaaaattaggagtagtggtgggtttagggtgggtattagttatgtatatgtatattagggatagggggttaaaggtagttagtttttaaagattgttttagaggttattttttagagaagttttgggttttttaagggttttgtgtttatgttggtttattttgtaggacgagtttgtggagtgggagatatttgattttttttaagttgagattgagtagaagattaaggagtataatgtttagattaatagtaatttttttatgagtttggtgagttgattgtttaggaagggggcgtggggaggagtaggtatttagttatgtgtttgatatttagagggttataattgaggttattttgggtgggcgtaagtagtaatttgtgtatatttagtttagttttaagtagattgatattttatttggaatttattattaaggtttggtttttttatttttttagaataaggacggtttttatataggttttattaaggtttagttgaagttggtgcgttttgtttttgtgttttttagtaagaagttattttttttgtaggatgttcggcggggtttaggacggggtataagtgttaggcgtcgtatttttttttatttgtttaaggatgttgttaagtatttgtatgtgttgttacgtataagggtacgtgaagttattgaggttttgttgcgaaagtttttggtggtggatgattttcgtaagtttgtattttttgagcgcgttgagcgttacggttaaggtgggttttttattttattttgttttatgtgagggtatatacgtatgtatttgagtatgtaggggttgagtagttggttttgtttttgattattattttttttttatagtgtatttgcggaagttgttggatgatgagtagtttttgcggttgcggtttttggtagggtttagtgataaggttttgagttttgttttgaaggaaaatgattttggggaggtgaacgtgagtatatagtttttagttttttggttgttattagataggattgatgggttgtagttatagtaaggtttggaggaggaattgtgttggaagataagttttgtaaaatagttttaggagtgtataggtattgtaattaaagtaaaggtttttagattatttatgttaaagtttagggttgttttaagaagttaggaagaattgttttggtgttttgattttttttggtgtggaaaattttttggagatgtaggagtttatttaatgatatgaggaggttttttttagattttttatttggaagttttttggttttaaggtattaggtttgtggagtgaaattagatttagaatatgtttgatttgtttataggtaattggggaatatttgatttgg

SEQ ID NO: 248 - DNA, 4448 bp, Artificial Sequence
  chemically treated genomic DNA (Homo sapiens)
tttattttttttatgtgttttttttgtttagttttgtttatttggtgtttttgatattttttttttttattttattgttttcgaggtttattttattttttggtttttaattatttatttatgtaggatgtgaatttttaaattagtatttaagatgtatatttggatatttattttaatgttttagttttaaatttaatatattaaaagttgtattttttatgtttattattagttttaaagaatgtataattgaataaaattttgattattattttatattttttttttttttgagttatttatagaggtgattaagatagaaatgtgtgttattttttatttattttattgttattaattatatgtatttattaaattatgttagttttatttttttaataattgtagtttaatatttgaataattgaataaaaatttataatttaatttttttaatatttatttattttaattttatttttataatttatatataatttataattatttttatataattggtatagtgataattttagataaaatttattgaatttttatttttatttttgttaatgatatatatatataatgtaatgttgagagggttgggaaggaagaatgggagaaaggtagaagttgatagttaaaaaaaaaaagtttttagatggtttttttagtgttatttttgtaattttattaaataagggtttaaaatttatgttataatatttgtttgatgttttatttaaattgttttattggatattttttatttgttaagttttttgaaagaaataaaattgttttgttatagttagattttatgattttatatatttataacgggtagattttgtaggggtttatattttttaaggtggtttgggaaaatgatatagaaaagttttatattagttgaaaagaaaaatgtataatttattttggtaattttagttttaatttttaataggataaaggaaatatgtatattataaattaatgttttgtgttaataaataattaagtaagtagagttgtaagtattggttaaaatgaattttggatatttttagttattaaatttttcgaggtaaggtagatatatatttggatttgaatatttgtattattagggaatttttgtttgtttgttttatattgttttgttatttttaaaagtaggtgttaaattaggttatttgttgtttgggtaatgttattttttgttataattataaattgaagaaaattgattgttttttttttttagttaatatgttgtgtttttagttttaaatatttttgagaagttgtttagatttatgagtaatgtttttgtttttaataggttaagatattaggtaggtttttgtatttttggagtttttagttttttgtaaagtgaggaagttagattaagtaatcgttaggtttttttttagatcgattaatttgatggtattagatgtaattgtttttgaattagggtatgaaatgaatttagttttggtgtattaatgtgatgattttgttttattaaagtttgagtacgcgataggtttagtattattttatatagagataaagggtaattttttgtttttaaaggaatgatataatttgtttttgaagtgatttatattatttttatttttgaataatttaatgtttagaaaataatttaagaattttcgttgattttagggatgtaagatacggttttttgatagtatttgggattgtggaaaaaagtaattgaggaaagggtatttttataacgtaatattgaatttagtgtttaaggtttattataggaatttttaacgatttttataattttttttttttttttttttttttttttttattttgaaaataaattgagaagttagtattgggataattattttttttgatttaaataaaaagttttgggtaaatataggtataaattgttaaatggaaaaagtttttttttatttttagttagagggaggttggggattttagttttttagaagtcggttcgtggacgtttagagaattttttcggagattaggttagggttattgagtttgtttagtagggcgtcgtttcggacgtcgtttcgttttttattttgttagcgtcgcgttcgggtcgcgaaggtgcgtgcggcgttcggtgattggcggcggttcggagttgttcggttgttattggttgttcggttttttttgttttcgggttcgggtcgtaggttcgttgcggcggattgggcggcggaagttcgacggcgtcgggcgagtggttgttgagcggcgtcgcgggagtttcgtaggtttttcgtgttcgtagcggagtcggaggttagttgaattcggtcgtgggatttcggataggaggaggaggggatttataggacgcgttaatatggatttggaaaataaagtgaagaaggtaggggggcgttcgtggcgggcggcggttgttttatttgcgcgggtcgcgcggcgcgcggcggtcggaggtgtcgaggtgggtggggttcgcgggtttttcggtgtgagttcggttttgggtttgcggtgtttcgggtttagggatttggttttttgggtagaggaggtgttcggcggtttcgttagttttttatattcgggagcgatagaattggaagcgcgagcgagggcgggcgcgggatttttttttttagttttacggaattttagtggttgtaggtgttggaaattttatttaagatgttttagttttgtttgtgtttttttaaaaggaaaggacgagtttagggcgagtgcgggcgagatcgtgatattttttggtttaggaagttgaattttattaagtttttgtggtttggggttttgttgtgttttgatagttttgattttttttttttcggttgggttgtttggggcgttttaaaatgagtgttgatttaatgtattgttttcgtattcgtgttggtgataatttttaatgtgatttttttttcggttatttattatttgtttatcgatcgaggtagtgttttttttttagggaattatttgttaaagagcgtattttttttgtttggtaggtagttttaaagggcggttgttattagcgttttagcgtagggagatatttttagtttggttgttgtttcgtaggtattggaatcgacggttttatttgagttattttcgggttatgcggagtttggtgtcgtttgggagaaaagggtggggattagattatgatttagaaggaatgttgatgttatattcgagtgaattgttttgtgcgaaagtttttttcgttttaggggatttgtttatgttttattttgtggtaaatttaagttagttgttttttattaaatagagaagttttgtagagagaggaagggaaaaatatagaaaatagtttttgttttttttatatttatggtttttaatattttattttttaaatataaagtttttgatttgagtattaattttattttatgtttagaattggatttttgaaaatggatataaaatattgtgttaggattgtagagttttcggttaggaagttattgattaataaaaattcgaaatgagaaaatagttttttttattttttgcgattaaaatttttaggtatttaaaaaggtatttaagaatagaaaaatataaattgttaatggtagcgtgattgtattttattttttttttatttggttttttttttttttttttttaaataattgtaatatttttggttaattttgtttgttatgggggaaaagcggggaaagtattttgttcgtttagttttttgttgatgaatattatttttatttagtttttaagtaggtaagagttatttaatttagtatttgtttaaaatttggggggttttgtttttgtttttaagtatttatttgaagataattttgtaaaagtaaatatattttgggttgtcgaggatgaataggtgaagtataggatttttagggtaatgatattattttgtatgatattataaaatggttgatatatgtaattatatattaattaaaatttatagaatgtagaatattaagagtaaattttaatgtaaattatgtatgttggggataatgatgtgttaatgtgttttattatttgtaataaatgtattgtattgatacgggttgttggtagttcgggaggttgttggagataggaaggtatgggggaggtatatgggaatttcgaattttttgtttaattttgttgtgaagttaaaaaatgttttaaaaataaagtttgtttaatagggggagaaaaattaaagatatttttgaaattttttgagataaggagtaattttgagggaagaagtttaaatttaaaaattgtatatgtttgtaaaggaaaaatttagacgttgtttataaataatttttttagagtttgaaaatgtg

SEQ ID NO: 249 - DNA, 4448 bp, Artificial Sequence
  chemically treated genomic DNA (Homo sapiens)
tatatttttaaattttaaggaaattgtttataaataacgtttggattttttttttgtaagtatatataatttttaagtttgaatttttttttttagaattattttttgttttaaaaagttttaaaaatgtttttgatttttttttttttattaaatagattttatttttaaagtattttttagttttatagtaaaattgagtagaaaattcgaagtttttatgtattttttttatgtttttttgtttttagtagtttttcggattattaataattcgtattagtgtagtatatttgttataagtgatgaaatatattgatatattattatttttaatatatatagtttatattagggtttatttttggtgttttatattttatggattttgattaatgtataattatatgtattagttattttatagtattatatagaatagtgttattattttaaaaattttgtgttttatttgtttattttcggtagtttaaaatatgtttatttttgtaaagttgtttttaaataaatatttaaaagtaaggataagattttttaagttttagataagtattaaattaagtagtttttatttatttgaaaattaaatgagagtagtatttattaatagaaagttaagcgggtaaaatgtttttttcgttttttttttatgataagtaagattaattaaaaatattatagttatttaaaagaaaaaaagaaagaaattaaatgggaagagaatagaatgtaattacgttattattaataatttatgtttttttgtttttggatatttttttgagtgtttgagaattttagtcgtaaggaatgaaaaaaattgtttttttatttcgagtttttattggttaatagttttttaatcgaaaattttgtagttttaatataatattttgtatttatttttaaaaatttagttttgggtataaaatagaattaatgtttaagttaaaaattttgtgtttagaagataaaatattaggaattatgagtatgagaaaaataaaaattgttttttgtatttttttttttttttttttgtaaaatttttttatttgataagggatagttagtttaaatttattataaagtaaaatatgagtaaattttttggaacgaggagaattttcgtatagggtaatttattcgaatgtgatattagtattttttttgagttatagtttggtttttattttttttttttaggcgatattaggtttcgtataattcgggagtggtttaggtagggtcgtcggttttagtgtttgcgaggtagtagttaagttgaaaatgtttttttgcgttgagacgttggtgataatcgttttttgggattatttgttaaataaggagaatgcgttttttgatagataattttttaagagggaggtattgtttcggtcggtagataagtaatgaatgatcgaaaaaaaaattatattagaagttattattagtacgggtgcgaaggtagtgtattaaattaatatttattttagagcgttttagatagtttagtcggaagggaggagattagagttgttaaagtatagtagagttttaaattataaaggtttaatgaaatttaattttttgagttaggaagtgttacggtttcgttcgtattcgttttaagttcgttttttttttttgaggaggtataggtagagttgaaatattttaagtaaagtttttaatatttataattattgggatttcgtgagattggagagaagagtttcgcgttcgttttcgttcgcgtttttaattttgtcgttttcgagtgtggggagttggcggggtcgtcgagtattttttttatttagggggttaggtttttgggttcggggtatcgtagatttagagtcgggtttatatcggggggttcgcgagttttatttatttcggtattttcggtcgtcgcgcgtcgcgcgattcgcgtaggtgaagtagtcgtcgttcgttacgagcgtttttttattttttttattttgttttttaggtttatgttaacgcgttttatgggtttttttttttttttattcgggattttacggtcgggtttagttggttttcggtttcgttgcgaatacgggaaatttgcggaattttcgcggcgtcgtttaatagttattcgttcggcgtcgtcgaattttcgtcgtttagttcgtcgtagcgggtttgcggttcggattcgggaataaagggggtcgggtagttaatggtagtcgggtagtttcgggtcgtcgttaattatcgagcgtcgtacgtattttcgcggttcgagcgcggcgttggtaaggtgagaggcggggcggcgttcgaggcggcgttttgttgggtaagtttagtgattttgatttggttttcgaagggattttttgggcgtttacgggtcggtttttaaagagttgggatttttagtttttttttagttgaagatggagaagaattttttttatttggtaatttgtatttgtgtttgtttaggattttttatttgggttaaggggaatagttattttaatattaattttttagtttatttttagggtaaagagagaaaaaaaagagagagagagagattgtagggatcgttagggatttttgtgatggattttgggtattaaatttaatattgcgttgtggagatgttttttttttaattgtttttttttataattttaaatattgttaagaaatcgtattttatatttttaaagttagcgaagatttttagattgttttttgagtattgggttgtttaaaagtaaagatgatgtgaattattttagaaataggttgtgttatttttttggaagtagagggttgttttttgtttttgtgtgagatggtgttaggtttatcgcgtgtttaggttttgatgaagtagagttattatattggtgtattaaagttgaatttattttatgttttaatttaggagtaattgtatttaatattattagattggtcggtttggaagggagtttaacgattatttagtttagtttttttattttgtagggaattgaggattttagaggtgtagggatttgtttaatgttttagtttgttggggatagaggtattgtttatgaatttaaataattttttaaagatgtttggggttggaagtatagtatgttgattaaggaaaaagagtagttaattttttttaatttgtggttatggtaaaaaataatattgtttagatagtaggtgatttaatttggtatttatttttaaaaataataaaataatataaaataaataaataaaaattttttaataatgtagatatttaggtttagatgtatgtttgttttgtttcgagaaatttggtagttaaaaatatttaaaatttattttagttaatatttgtaattttgtttatttgattatttgttaatatagagtattgatttataatgtgtatgttttttttattttattaagaattaaaattgaaattattaaaatgagttatgtatttttttttttagttgatgtaaaatttttttgtgttatttttttaaattattttgaaaggtgtgggtttttgtaaagtttgttcgttgtaagtgtataggattatgaggtttagttatgataaggtaattttgttttttttagagagtttaatagatggaaaatgtttagtaaagtaatttaaataaggtattaaataaatgttgtaatataaattttggatttttatttgatgaggttgtagagatgatattaagaaaattatttggaaattttttttttttaattgttaatttttgttttttttttattttttttttttaatttttttagtattatattgtgtgtgtgtattattggtaaggatggaaatagaaatttagtgagttttatttggaattattattgtgttaattatataaaaataattatagattatgtataaattataaaaataaaattgaggtagataagtgttaagagagttaaattgtaagtttttgtttagttatttaggtgttaagttatagttattaaggaggtagaattggtatggtttgatgagtatatgtagttgatgatagtggaatgaatagaagatggtatatatttttattttgattatttttatggatagtttagaaagagagaaaatataggatgatggttagggttttgtttagttgtgtattttttggggttggtggtggatataaaggatataatttttaatatattgagtttgagattgagatattgaaatgagtatttaaatatatattttgaatgttgatttaggagtttatattttatataaataaataattaaaggttaagaagtgagatgagtttcggagatagtaaaataaaagagaagaatattaaagatattaagtgagtaaggttgagtaagagaaatatataaaagagataag

SEQ ID NO: 250 - DNA, 4408 bp, Artificial Sequence
  chemically treated genomic DNA (Homo sapiens)
ttatattgtgagtatataaaaagtattatacggttaacggaggacgaggaattatggtaaagtaggtaggtaagttttaagaaataaaataatttgttaaaaaataatttttgatgattatcgtaagattgaaagtgtaggaaaaatatagttcgaataattttagatttttttatattttttttttttttatatattttgttattttataataaaatttttaatggaaagtttaaaaataaatagtataggaatatgtgttttaaatgaattaaattgtgaaattagttagtaaattaatttgtagtaagtaattatttaaggaaattaaaatattgtttagtttagttttgtattttattatgtgtatgcgttttttataattaattaatataagtgttttaggaatatttgaagataaatacgtttaatttaaggaataaagtatttaaataatttaagtgtaattttgttgagttaaagtaaaatattttataaatgaagtggttatttaattttttagggaaagtttggttattgaaatgttgtatgtttatgttatattaataaaaatttttaatttattttgtttatgtgttttgtttttttgatattattggtatttgaattttagatggatttttgttaaaatgatattttgtgtgataaaagtatttttagttttgattgatagattaaaataaatgtaaggaaatttttttaaattagattaattttttataaaaatattttagaatgtatgaattttgatatttatatttataatggtaaaagtttttttcgtttagtttagtaagataatatttatataaaagagtaaaaaaaaattatattattttatgatagtttgatttttaaattgtttaagaaagtaaagtggttaaattggaaaagaggaatatatttcggaggtttagaatcgaaaattttttttttaatttttagttggaaaataattttttgtatttatttaaagtgtattttttgaagtgttagattggagttgattggtgattaatttaaaggagttataatttaaagaaatggtgagagtttggtatttaggtttggtttttaggtaattcgtttgggtttgagaggttattaattgttagttaagatggaattttttttttttttttttttttttaatggataataatgggaagggggttaattttttagtagttgaaattttgtatttagttttttattttgagaatgttaatttttggttcgaggatttgtttttgtagtgttggtatcgagatttaagggaagatatttcgttttaaatgttagttacggtttggtttttttttcgattttagtattttgtagattgttagtgtttgtggcgggggacgaaaggaatagggttttgtaaggtttgtttgtcgattgcgttattttgggcgaaatttagttttaaaagttataaattatttacggtgaagatttttcgaagtggaataaatttttagattcgtattattttatatttttgcgggatagatggtttttatttatcggttatcgggagagagttgttgttttcgcgttttattgtttttcggggcgatttttagcgagtcgagttttcggttgtacggtaagcgttcgaaagtcgggtttgagaggattgtagggtttttgagggtgttaagtttcgaaggagtttacgggtgtattggggttttcgaaatttagtcgttattggtagtttttttttgtttttttttagttttttcgttcggtttcgtattttttttttttttttttttttttattttttttttttttttttgtttttatttcgtgtggggagtgacgtgacgttagtagagattttattaaattttattgtatagtggcgcgcgggcggtcggtcgagttcggttgcgcggttggcgatttaggagcgagtatagcgttcgggcgagcgtcggggggagcgagtaggggcgacgagaaacgaggtaggggagggaagtagatgttagcgggtcgaagagtcgggagtcggagtcgggagagcgaaaggagaggggatttggcggggtatttaggagttaatcgaggagtaggagtacggatttttattgtggaaaggaggattagaagggaggatgggatggaagagaagaaaaagtaatttgcgttaattcggtagttttaataaattaaagggggagcgttagggtagcggggagatagaaacgtatttttggggagtaaattaggacgggttgggaggaagcgatagggaaagtggtttaagagacggaataaaggataatgtttatggggttgtttgggacgaggcgtgtggagtgtgggtgtgagcgtgcgtgtgtgatttttttttaggtttgtagagttgaggaaagaggttatagtaaagagggattgcggagggaggaaagtgagagatcggtagagggcgggagtggaggtgggcgcggtggggatgggagaggatgagtgaagagaaatttagaagaatggagtgagttagtgggagagggtgggagggttatagtcgggagcgaacgagttaggtttgttagttggggaaggtcgggacgttgggtttagtttagttgggatatcgcgttcgaggttaaggcgggtggattaggtatgttgagagtgtcggcgtataggtgggtacggttacgtattgatttagtgtttacgaagggtttgtattggataaggtttagacgtttatagagtttagaattttttttgttgtatttatatttaataagtttattttgggttacggatattttattttttaaaatgacgaggttaaggtttttggcgaggatggtattaaattgtacgggatagaagtgggggtgggggagagagttttttttaagtttatatttgtttttgtaaagtaaagagtatgtgaaattatagggtatatttttattcgaaaagtgtgttttatttttgaattttgattttttgattttttgatttgagtaaagatgtgtattttggtagtgagtagaatattttggttttgttttgtttttgagtggaaggattataaatataattcgtttggaggattaggtgtgaaggtttttgttaggtatatgggataatgtttttttaattttaagggtattttgttaatgtatgtttttggaaagtgtcggaatatagttattgtttttggattcggatttttttattaatattaatttttgtttgagagtaaaatttaggttcgttattaaaaagatatttttttggtttttaattgagaataaagttttttttaaaagttgtattgttttttttaaattaatatattaatattcgtaattttagaaatatatagtgattcgggagaatgtgtataaaatagatacgtttaaaaaagtttggcgtttaaaattaattttagttattatataggtgttgggttttttttatttttgggggttgtttggaatatgttatgtgtttttttgaattatttcgtgttttgaatttatttgagttagtagtaaaaataggtaaataaatttgtttaatttgttttgagtgttaaatttttttattttgaaatagttaatagtcgatagatggatttattttatggaaagggttagtttttttagttacgaagaaaattgattagagatttatattttaagttatttttaatttttacgtaatattcgtgaaaatttaaattttttttttttatttagtggaaatttaaagtagtgttatttaaggggagagaaatgagggggaaaatgtttacgtgttgtttaattgtattttttttttgattttgagaatttttatttttggtttttgaaatttcgtcgaggtaagaaaattaaatttttttaataagttttataattgaattttagttataggatatcggaaagtgtagttcgagaaagatatttttatttttgtttatcgacgatttttgtagtttttttatttttttgagtaatgggttaataattttttttttttttttttttattttgtagagattaagaggcgttcgtagtagaacggttttgtttttagttggtggcgaggataggtaattttatggaaaagttggaagagaatgagaaaattaaagatagaaagatttagagattcgcggagagatatagggagagggaagggagttgcgttgaaaagacgtaaagatacgcgcgtgtaattttttttttttttaggttttagaggtttgtaaattagggttgagaggaaggggttcgggaagtttacgtttttttcgttttttttttgtttggagtttcgttcgttagaggttggttaattttagtttcggtcgtcgtagatattgcgttgagtttttgggttt

SEQ ID NO: 251 - DNA, 4408 bp, Artificial Sequence
  chemically treated genomic DNA (Homo sapiens)
ggatttaaaagtttagcgtagtgtttgcggcggtcgggattggggttaattagtttttggcgggcgagattttagatagaaggggggcgagaggaacgtgagtttttcgagttttttttttttagttttggtttgtaaatttttgaaatttgaaaggggagggagttgtacgcgcgtatttttgcgtttttttagcgtaatttttttttttttttttgtgttttttcgcggatttttgaatttttttgtttttggtttttttatttttttttaatttttttatgagattgtttattttcgttattagttgaaggtaaggtcgttttgttacgagcgttttttaatttttataaaatgaaaagaaaaaaagggaggattattagtttattatttagaggaatggggaggttgtaaaaatcgtcgatgggtagaggtgaagatgtttttttcggattgtatttttcggtgttttgtaattagagtttagttgtgggatttgttgaagaaatttgatttttttgtttcggcgagattttaaaaattagaaatagaaatttttagagttagagaggaaatataattaaatagtacgtgggtatttttttttttatttttttttttttaaataatattgttttgagtttttattgggtaaagagagaaagtttgagtttttacggatgttacgtggaggttagaaatggtttaaaatgtagatttttaattagtttttttcgtggttgaagaggttaattttttttataaaatgagtttatttgtcgattgttagttattttaaagtgaagggatttagtatttaaaataaattgagtaagtttgtttgtttgtttttattgttaatttaaatgaatttaaaatacggagtaatttaagaaaatatataatatgttttagatagtttttaaaagtagggaaagtttagtatttatatagtgattagggttagttttaagcgttaagtttttttaaacgtatttattttatgtatattttttcgagttattatatatttttaaaattgcgagtattggtatattgatttaggaagagtaatataatttttagagggaattttatttttaattagggattaaagagatgtttttttaatagcgggtttgagttttgtttttaagtaggaattaatattggtgggaaaattcgaatttaggagtaatggttgtgtttcggtattttttaaaaatatatattaataggatgtttttgagattgaaaaaatattgttttatatgtttggtagaagtttttatatttggttttttaggcgaattatatttatagtttttttatttagaggtaggatagagttaaaatattttgtttattattaaaatatatatttttgtttaagttaagaaattagaaaattagggtttagaagtaaggtatatttttcgagtgagaatatgttttgtaattttatatattttttgttttgtaggagtaaatgtggatttgagggaaatttttttttttatttttatttttatttcgtgtaatttaatattattttcgttaggaattttaatttcgttattttaaaaaatgagatattcgtgatttagggtgaatttgttgaatgtaggtatagtagaggaaattttagattttatgagcgtttgagttttgtttagtgtaaatttttcgtgaatattgggttagtgcgtggtcgtgtttatttgtgcgtcgatatttttagtatgtttggtttattcgttttgatttcgggcgcggtgttttagttaagttgggtttagcgtttcggttttttttagttgataagtttagttcgttcgttttcggttgtggtttttttatttttttttattagtttattttatttttttagatttttttttatttatttttttttatttttatcgcgtttatttttattttcgttttttatcggttttttattttttttttttcgtagtttttttttgttgtgatttttttttttaattttgtaggtttgaaagaaggttatatacgtacgtttatatttatattttatacgtttcgttttaaataattttatgaatattgttttttgtttcgttttttgggttattttttttgtcgtttttttttagttcgttttgatttgttttttaaaagtacgtttttgttttttcgttgttttggcgttttttttttgatttattagggttgtcgggttggcgtagattgttttttttttttttttattttatttttttttttggtttttttttttatagtgggagttcgtgtttttgtttttcggttggtttttaagtgtttcgttaggtttttttttttttcgttttttcggtttcggttttcgatttttcggttcgttggtatttgttttttttttttgtttcgtttttcgtcgtttttgttcgtttttttcggcgttcgttcgggcgttgtgttcgtttttggatcgttagtcgcgtagtcgggttcggtcggtcgttcgcgcgttattgtgtagtggagtttggtggaatttttgttgacgttacgttattttttatacggagtaggagtagagggaagagagagggatgagagggagggagaggagagagagtgcgagatcgagcgagaaagttggagaggagtagaaagaaattgttagtggcggttagatttcggaggttttagtgtattcgtggattttttcggaatttggtatttttaggagttttgtagtttttttaggttcggttttcgggcgtttgtcgtgtagtcggaggttcggttcgttggaaatcgtttcgggaagtagtgggacgcggagatagtagttttttttcggtagtcggtaagtggaggttatttatttcgtagggatgtgagataatgcgagtttggaaatttgttttatttcggagaatttttatcgtaggtgatttgtggtttttggggttaagtttcgtttaaggtaacgtagtcggtaaatagattttgtaaagttttgtttttttcgtttttcgttatagatattaataatttatagggtgttgaagtcgagagggaagttagatcgtggttggtatttaaaacgaggtatttttttttaaatttcggtgttaatattgtaggaataaattttcgggttaaggattagtatttttaagataaagggttgggtataaagttttagttattggaagattagttttttttttattgttatttattgggaaaaaaaagaaaagaaaaagattttattttaattggtagttagtgattttttaggtttaagcgaattatttgggagttaggtttggatgttaagtttttattatttttttggattgtaatttttttaaattgattattagttaattttaatttggtattttaggagatatattttaaatggatgtagagaattattttttagttggagattaagaaaaaaattttcgattttaaattttcgaaatatgttttttttttttagtttaattattttatttttttaagtaatttagaaattaaattattataaggtggtgtgatttttttttatttttttgtgtgagtattgttttattaaattaaacggaaaaaatttttattattataaatgtaaatattagaatttatatattttaaaatatttttatgaaaaattaatttgatttaaagaaatttttttgtatttgttttagtttattaattaaaattaaagatgtttttattatataaaatattattttggtagaaatttatttaaaatttaaatattaataatattaagaaaataaagtatataagtaaaataaattgaagatttttgttgatgtaatatgagtatataatattttaataattaaattttttttaaaaaattaaatagttattttatttgtggaatgttttattttaatttagtaaaattatatttaaattatttaggtgttttgttttttaagttaagcgtgtttgtttttaaatgtttttaaagtatttatattaattggttgtaaagaacgtatatatatggtaaaatatagaattgaattgagtagtattttaatttttttaaataattatttattataaattaatttattggttaattttataatttagtttatttaaaatatatgtttttgtgttgtttatttttaaattttttattaaagattttgttatggggtaataaagtgtatgaaaaggggggaaatgtgaaaggatttgggattattcgaattgtattttttttgtatttttagttttgcggtagttattagaaattattttttagtaaattgttttattttttagggtttgtttgtttgttttgttatggtttttcgtttttcgttagtcgtgtagtgttttttgtgtgtttataatataa

SEQ ID NO: 252 - DNA, 4435 bp, Artificial Sequence
  chemically treated genomic DNA (Homo sapiens)
gttttttttttggtcgttacggtttacgttattaatttatagttattttttcgtttgttatggttttttgttttcggtttatgaattttcgggttgtttagattggggttgggggtggttgaattgggggtttaaagttatttatatgaaattgtatgtattttcgttagtttggggaagggagttgattttttggagatttagaatttagaagagagatttttagtaagtagtgggggtggaatttgtgtttttagtgtttttaaattttttttgagttttgcgacgttttttaattttcgttcgtaatttttttttttcgttagttttggtgggttttttatcggcgtacgagcgggatttttagattttgagtagtagtaagatgatggcgaggaggtgggagaggttttttaggaatcggaagagatttatggttggggaattttggtagggttgagcgggagggaggtaggttggcgggggggtgtttttcgaggttgttggtttgaacgggtagttgggttggggggacggaagagggattttaggtgcgtttcgtttcggggaggggattttgggagggggagtaaaggttggagttggcggcggagttggagtcgggaagagggaggagagcgagagggggaggagttcgggaggagaggtttcgttttcgagggcggggtttggattttcggcgttttttatcgtttattttttgttttgtcgtggcggcgttaaacgtatttttaaagttgttttataggaatttgggagggtcgtagggttcggaaagtgttaaatttagtatcggttcgtttaggtagtttgtgtttttggaagagacgtagtttagtatattagttttagtttttgtagggatgtagagattgttttttgagtttgaaaaattttgtagggattcggaggtttagttgttagtttttgtagtttttaggtattttaattttaattttttagaagataagaaagatattttatttatttttttttttagatttaggatttaaggttttagttcgttcgttaaatttagaagtttgggtttttagtttttttttttttagatttaggagtttagatttttagtttttttttttttagatttagaagtttagatttttagtttttttttttttagatttaggagtttaggtttagttttttttcgtttagatttaggagtttaggtttttagtttttttttttagatttaggagtttaggtttttagtttttttttttagatttaggattttaggtttttagattttttttttttagatttaggagtttaggtttttagtttttttttttttagatttaggagtttagatttttagtatttttttttttagatttaggagtttagatttttagtttttttttttttagatttaggggtttagggttttagtttttttttttttagatttaggggtttagggttttagtttttttttttttagatttaggggtttagggttttagtttttttttttttagatttaggagtttagggttttagttttttttttttttaggacgttgttttttggaatttagggttttatttttattattttatggattaaatattttaattttaagaatttagatttatagtttttttttttacgatttatagatttaggttttgattttttttttttttaggaatgtgtattttattttgtttttttagattttgaggatgaaggaaataggagttttatttaggaggtttaaggttaaaattttgatttaaattattttaggagtttttggttttggttttttttttgttttagagtttttgttttgtttatatatatatatttttttttatttttagaggtttcggtgttttgttttacgttttattttagagttttacgggtggttttataaaagtgtcgggtttagttttttagtaggaggggaatgttgggtatttgggtgtgggattttcggggaatagtttgtggtttggatttttgtatttatgaggggatagacgtggtttttttttcggatgatggggtatttatagatgatggaggttagggttttttaataaaagaaggggtgtaggcgtgttgatttttttagagggttggaaggacggggtgtttaagggtgatatttacgagttttgggtttttgagggtggtttgtacgggggagagtcgggatgattgagtttttaaaagagatttcgatttggaggcggtttttaaatttttgggttttagtagagaaggggatttttgggtttgagggaggaggggttggggggtgggatttttgggattagggtcgagatttggtttttaggtttggttttttggggtaataaaagttatagtttgggttttagtgtggcgaatattgaagttagggaaaggttttttgtttttagagttttaaggtagggcgggggtagagggtagtaatttttagttttggagtttagttttgaagttggtgtttttatatcgggttttgagtttttgtttgtttgtttttagtttgatttttttttttttttttatttttagttttttatttttttgttttaggaggaaggtagaggttggtagttaggggtggggggcggttttttttttaagtttggtaggagaaggggtttttagggaggttaggagggggggttgtgggtttttcggtagtggtagacggggattgaatgttaatcgtatttcgagtgagtgtgtgtgtgcgagaatatagcgagtgtgtgagtttttttcgttttagtttttttaagtcgcggtcgtcgtcgttattttcgttcgtagtttttcgtagtttttttcggttatcggtgtttgttgggggtgttgtttgggtaggtcggttcggtttttaggggtttttcgagcgtttgttatttgttcggtgaggatttgtgtgttcgggtgtttggggttggttggtggagggggggtgtgtttgtaagcgttgcggcggcggagggagggaggggtttgtttgtttgtatcgattttgagttgtttgtttgggtgtcgtggggttttcgtttttttttttcggtttttttaaatttagatggatggtgtgtatttgggttttgtgttttttgtttgcgttcggttaggcgtttgggcgttttcggttgtttgtgtttttttgtttgtttaaatagtttttattagtagtggtagtttggtttttattagattttttattttgtgtgtgtgtgtttgtgtgtgtgtttttttttaagttttgggggtgttgagggggaattttagggaagtgagatcgtgcgtgtgtgcgtgagtgtatgtgtgtttttgtttgtgtttgagagtgggggagttaagggggggtttagaggtggttaagcgaggaaggggtaagtagttttttaagtaggtaatttttcgttttttatacgtatatattagttattagttttagaggtgatttagatagatagatagatatagacgttggaagggggggtgggggggttgagggtataaagcgggggtgcgagtgagttagggagaggcgggattggatatatggaaaggggggaggagtcggggttgaagcggtagaggggggtatttcgggtgggcggaggggggatttttacggggtcggggcggtaagaggatatttcgatagtttttgtaatgttcggggtttaatttttagagtaatatgtgtagttacgttttcgtttagtttaggtggtcgtaattttgggggagagatagggtaggataggattaaggaagaggaaggagagacggagttagggatagataggaggttcgggttgtcgttgttgtcgttattattattgtcgtcgtttcggggtttgtttttcgatatcggttttttgagtttttttcggaattttggggtcgttggacgtcgggtttcggttttggttttttcgttatttttttaatagaatagggttatgaaaaggtaaggcggggataggggatgtagggatggtggtgggaatgtggatttttaaatttaggatagaggaagttggtaagaagtttcgtggagggagggggtttgaacggtgggtaggggttttgatttttatttagtttttttgttttttagggatttttttttattttttttttttttttttttgagttttttttttttgagtttttatattttagattttttacgtttttatttttttgatatttggttttttttttttatttttatatatttgatgttttatatttttgtgtttttatttttttattttattttttttttgtatttttttttttgtattagtttttttatcgcgagtcggtttttttttttttttttttcgttttttttttttatgttagagttatgagtttgttattaat

SEQ ID NO: 253 - DNA, 4435 bp, Artificial Sequence
  chemically treated genomic DNA (Homo sapiens)
attaatagtagatttatagttttgatatgggaggggagagcgagaggagagagggagaggatcggttcgcgatggggggattgatgtagggaggggggtatagggagaaggtgagatagagagatggaggtatagggatatggggtattaggtatgtggggatggggagagggagttaagtgttagagaaatgggggcgtgaaaggtttgaggtgtagggatttaggaaaaaggggtttagagagggagagagagagggtggaggagagtttttgagggataggggagttaggtgggggttaagatttttgtttatcgtttaaattttttttttttacgaggttttttgttaattttttttgttttagatttgggggtttatatttttattattatttttgtattttttgttttcgttttatttttttatgattttgttttgttggggggatggcgggggggttaggatcggaattcggcgtttagcgattttaagatttcgaggagggtttagagagtcgatgtcggggggtaggtttcggggcggcggtagtggtggtggcggtagtagcggtagttcggattttttgtttgtttttggtttcgtttttttttttttttttttggttttgttttgttttgttttttttttaaggttgcggttatttggattaggcgaggacgtggttatatatgttgttttggaagttgggtttcggatattgtagaggttgtcggggtgtttttttgtcgtttcgatttcgtggggatttttttttcgtttattcggggtgtttttttttgtcgttttagtttcggttttttttttttttttatgtgtttagtttcgtttttttttggtttattcgtattttcgttttgtgtttttagtttttttatttttttttttagcgtttgtgtttatttgtttgtttgggttatttttgaagttagtggttggtgtgtgcgtgtgaggagcgggagattgtttgtttggggaattgtttgtttttttttcgtttggttatttttagatttttttttgatttttttatttttaaatataggtagaaatatatatatatttacgtatatacgtacgattttatttttttgggatttttttttaatatttttagagtttgaggagggatatatatatagatatatatatatagagtggggggtttaatgggggttaggttgttattgttgataggggttgtttggatagataggaggatataggtagtcggggacgtttagacgtttggtcggacgtaggtaggaggtatagaatttaggtatatattatttatttgggtttgggggggtcggggggaaggagcgggagttttacgatatttaggtaggtagtttagggtcggtatagatagatagattttttttttttttcgtcgtcgtagcgtttatagatatattttttttttattagttagttttagatattcggatatatagatttttatcgggtagatggtagacgttcgagagatttttgggggtcgggtcgatttatttaggtaatatttttagtaggtatcggtggtcgagggaggttgcgggaggttgcgggcgagggtggcggcggcggtcgcggtttggaggagttggagcgggagggatttatatattcgttgtgttttcgtatatatatatttattcgggatgcgattaatatttagttttcgtttgttattgtcgggagatttatagtttttttttttggtttttttggggatttttttttttgttaggtttggggagggggtcgttttttatttttagttattagtttttgttttttttttgggataagggagtgaggggttgaaaataaaaagggaggaagaagttaggttggggataggtaggtagggatttagaattcggtatggagatattagttttagagttagattttagggttgggggttgttgttttttgttttcgttttgttttgaggttttggaaataggaggtttttttttgattttagtgttcgttatattaagatttaagttgtggtttttattgttttagaaggttaggtttgaaaattaggtttcgattttggttttaggagttttattttttagtttttttttttttagatttaggagtttttttttttattgggatttaggaatttggggatcgtttttaagtcggagttttttttaaggatttagttatttcgattttttttcgtataagttatttttagggatttaagattcgtggatgttatttttgggtatttcgtttttttagttttttgaagaaattaatacgtttgtatttttttttttattgagggattttggtttttattatttgtgggtattttattattcggaagggaagttacgtttgtttttttatagatgtaggagtttagattataggttgtttttcgggggttttatatttagatgtttagtattttttttttgttagagggttgggttcggtatttttataaagttattcgtggggttttggggtagagcgtggggtaggatatcggggtttttgagggtggaagagggtgtgtgtgtgtgggtagggtagaaattttggagtaggggggaagttagggttaggggtttttgaggtagtttgggttagagttttggttttgagttttttgggtgaggtttttgttttttttatttttaaggtttgggagaatagggtgaggtgtatatttttgaaaaagaagagaattagggtttaaatttgtgggtcgtaaagggagaaattgtagatttagatttttaaggttaggatgtttgatttataagatggtgggggtgggattttaagttttaaggaatagcgttttaggagggaaaagggttggggttttgaatttttgggtttgagggaggaggggttggggttttggatttttgggtttgagggaggaggggttggggttttggatttttgggtttgagggaggaggggttggggttttggatttttgggtttgagggaggaggggttggggatttggatttttgggtttgagggaggaggtgttgggggtttggatttttgggtttgagggaggaagggttgggggtttggatttttggatttgggggaggagggtttgggggtttggagttttgggtttgagggaggaggttgggggtttggatttttgggtttgagggaggaggttgggggtttggatttttgggtttgagcgaggaggagttgggtttggatttttggatttgagggaggaggggttgggggtttggatttttgggtttgagggaggagaggttgggggtttggatttttgggtttgagggaggaggggttggggatttagatttttgggtttgacgaacgggttggggttttgagttttgggtttaggggaggaagtaggtggggtattttttttgttttttgggggattggagttagagtgtttgaaagttgtaaaagttagtagttgagttttcgggtttttgtaggattttttaagtttagagggtagtttttatatttttgtaagggttgaggttggtgtattggattgcgttttttttagagatatagattgtttgggcgaatcggtgttggatttggtatttttcgaattttgcgatttttttaagtttttatggggtagttttgggggtgcgtttagcgtcgttacggtaaagtaggaggtgggcgatagggggcgtcggggatttaggtttcgttttcgggggcggagttttttttttcggatttttttttttttcgttttttttttttttttcggttttagtttcgtcgttagttttagtttttgtttttttttttaaagtttttttttcggagcggagcgtatttagggtttttttttcgtttttttagtttagttattcgtttagattagtagtttcggggggtattttttcgttagtttgtttttttttcgtttagttttgttagggttttttagttatgaatttttttcgatttttgggagattttttttattttttcgttattattttgttattgtttaaaatttggaagtttcgttcgtgcgtcggtgagaggtttattagggttggcgaaggagagagattgcgggcgggggttgggggacgtcgtaggatttaggaagggtttgggggtattaggggtataggttttatttttattgtttgttggggattttttttttaggttttgggtttttaggggattagtttttttttttagattggcgggggtgtatatagttttatgtgaatggttttaggtttttaatttagttatttttagttttaatttgggtagttcgagggtttatggatcgggaatagggaattatggtaggcggggaggtggttgtgagttggtgacgtggatcgtggcggttaggaagggaat

SEQ ID NO: 254 - DNA, 6001 bp, Artificial Sequence
  chemically treated genomic DNA (Homo sapiens)
gggtatagtgtgaggaagaaatatggaaaagatagattttttttagattgaaaaggagattgtttaggggcgggaggaagataaatagaggttagtgggttttgaggttgattgtatgtgtgatttgtgtttttgaaatattattttggaaattgtaggattttcgggaggaatggttgtaggggatgttttagtagatgagataatagttatcgttattttattttaaatttttgtgtttttagtgggatatagaagtagtaggttgtttattaatttaagtagttatattagtttgggtagtggaaataatttagttatattttttgggaatagaggattaaatggatgtgttgtttttttttttaatttattatatgggattgtgtatagttttggtgttaggaattaattttaggaaggatgaaggttgatttttttagtttttagtagataagttgttaggggtagttattaatatataataattgagttatttacgtaaaataatggatatgtgatgttttttgtatgtttgagtttttgggttgagatttattttgttttgaatgtcgcggtttttttaatgaagttgttgaggaacgtaggggttttgtttattttgtttttttttggaaattttgttttttaatttttagatttagagtagtgtttttgtttttagttttatatcgtttatatttttattaggaaaagtaaataaaagttaaagttttgtttagttataagttttttttaaacggggtagttggattgtatatatttttggcgtattaattttatttagatagggaaaatatttttatattaaaagaaattaggttaaattatggtagagaatgtaaaatttatagtttaaaaatgatgaaattttagattttaaaggaattttttttttgtagggtagggggagggtattttgttttagaattttatgcgggtttttattggagtttttttgagaaggatatttttgtggaaaagtttgagtagttttggttttgcgtttggtttggttaggggttatttttttttggtttgggttgtagcgttttatgggtatcgcgtttttgttaatatttttttacgtttttaaatttatagtttgttagcgcgggcgtaatttgagagttgtcgtaggtttttagtttattcgttttttaaaggaggaaatggagaattagcgattttaaaggatttgtttggcgggtatttacgttttttaggttatcgtttttttttgcgtttttggttattttcgttttttaattttgtaggaatttaggatttacgtgtaaatataaagaatcgtatttatttattttcggtttttttttattttgcgtttttaattttgggggggttttttttttttattggggtatttgacgttcgtggggggtgtttagaaaagtttggtagattagtgattggtggttttggaataaatatattatagtttaaattgggggttggtggtggagaggtgggtggatgggggttataaatttgttcggtaattgtttttttagttaagagagaggagttgaggttttttggggttggaggattggaatcggttagattgcgggtttaaggggcgaaggtaggttggtaggggtagttttttttcgtcgtttataattttcgggcgggcgcgtagtcgagtcggttcggttggttggcgtaatttcgcgcgttttttgtattgattaaaaatgggggttgaaatagtaaacgcgaggaggagtaattgtttcgattcggtttagaagcgcgattaatggggatgtgagttttttcgcgcgaattaattagcgtagggtttgcgatagtacgggttaatggggcgtcgattcggcgtaggaataaggcgggggttcggggtcggttgtagatttttatcgtagcggttaggaacgttagtcgtttacgcgttcggttttttttggttgatttatcgttttggtcgtcgtattatggacgtttttaggtaggtggttaattttgggtttggtttcgttaagttgtcgtatttagtaagttttcgcgagcgggcgtcgggagtgaggtttaggcgggagtacgtacgcgggtgggtttgtatttttgcgtgtggtagtcggattttcgttttttgttttgagttttttaggcgttttgtattagcgtgtatagcgggattagtagtttcggtaagcgggtttcgggaagaatgtagttggtgaggaagttcggcgaggcgtgttcgtgtagttgtttttggttttgattgttggtgcgaggtagtgtacgatttagttggtcggggtttgttgtttcgtcggtgttacgtatttgtagacgttcgggttgtgttattttttgggtcggttcgggggttggggcggggcgaaaaagaaaaagttttgatttttgttttcgtttcgcgtagttgtgcggcgagttcgggtagtgtggagcggatgtatgaatggatatagtgtgaatgagtgatgaacgggaatgaatcgatgataggttttgtatatgtagtggattacgttagttgaaagggattgtaaatttaaaggttcgcgtgtgcgtgtttttttacgttttatattagtgtttgttttagttagtatttaggaatattgttttttagaaatgtaaatttgaaaatttttagtttagtttttttttttttgttttttatagaatttatttttttttaaagtttttttttttattttttttttttttttaatttgtttgttttttaaaggcgttcgagtattttaattttggtagattttgggttgtttaatttaattttttgtttatttcgttttggagtaaatcgagtgattgaattttttttcgggttataattagattttgttggtggaatttattttttgtttttttaggttttagttcggttttttttttttttcgttaaatttatcgtttttagttttattcgtagtgaagaaggtaaagttttcgatgtgttttgagtttattgttaggcggttgtcgtcgtcgttagatttttatttttttaattaggatagagttgataatatgttggagtagtatgaggtatagttaagtattttataattattaattgttgagtagagtagaaatttttttgggatagagttttttttgtgttgtggtaagaatagagaatttaattttaaaggggaaaggattttttatttttttaggggtagcgtttatagtagttgagaggatagggtttatttttttttagtggttatagtttattttaggcgagattttttgttttagttgtggagatgttttttgtagtttttttttgtattttttatgttttggagtgtttttaacgtttgttttttatgtatttcgttattaatttattattataattgtaatggtaattgttattagtaatataattatttgttattaatttttttgggaggatttttgtttttggattgtatgtaatttggggggtaggagggtgagggggtaggtagatgttgttttttatgtatttttttgatttagttgaattgtaaatattagagaagtttttaaattttttttgattgtaatttatagtgaaaaatatgtttataaaatgataaagtatatatatttaattgtaataaaaataaatgttttatgaaatgatgtgtagtttaattatttgtgatatatattattttgtattttattttgttttagtttgttttgttttattaaaaaaattagtcgtgagttgggtgtggtggcgtacgtttgtaatttaagtaatttaggaggttaaggtgggaggattttttgagtttaggagtttgaggttgtagtgaattgtgattgttttattgtattttaggttgggtgatagagtaagattttgttttttaataaaaaaaaaaaaaaaaaaaaaaaaaaaattggttatgatttataaaagtaatgtattttttaattggaaaaaaaaaaatttattggattagggaggtgtgattttttagtaggagtttttaaaattgtttgtaattattttggttataaatttttatagaattatttttaatgaatgttgtttataagaaagatatagttttaggagtaagtttaaagattatttatagatgaatgtttttttttattaaaagaaaagatttattttattttatttgattagttggtgttaataagtatttaatattttagaaaataataatatatttttagatttagtcgttaaggtagttttttttttaatttaatttttttttttttttttttttgagagaagttaagttttgttacgaggttggagtgtagtcgtttggtttcggtttattgaaattttcgtttttcgggttttagcgatttttttgttttcgttttttgagtaattgggattataggtatttattattaagtttagttaatttttgtatttttagtagagacggggttttattatgttggttaagatggttttaattttttgattttatgatttgttcgttttggttttttaaagtgttgggattataggcgtgagttattacgttcggttttgtttaattttttattgttaaaatattgttttttgagataagttgtaatttagtttaggttatagttgtgttttaatgatgttttttttagtaagtattttaaaaaaaaaggtgttttttatttgtagattttttttggttggttgtttttgtatttattttgtgtttatttttaaagtttttttttttttttttattttttattaagggaatttttatatatataaagataaaagtagtgtaatgaatttttaaggatttatttttgagatttaataattattaatattgtgttagttttgttgtagtattttgggacgaattttatttatagtaggtttttttttttttttgtttattttacgttttttagtttagtattttagattaaaagagatcggaaaattgagttatttgtataatttgggtataatttttttatcgttgtttttttaatttagaattttatgtattttttattttagttttaggagagtggtgaatgagatttgtgaaggggatattttttagggaatcggtaaattcgggtttttggaaaaagtgtattaatattagttatattgtttaattttatgtttattttgtgtgtaagttgtataatcgttggttttgtggatatgggaaggaaggagattggttgtgggtggggatggaagtttggggattttattgtagatttttttttgttttttcgttaggtttgtatgtttagagggaaagtagtgtagaatatatttaaataattttatttttttttatttttttttaggtgttgttagagatataaaaggaattattagattataaaggagttggtattagtgtttttggtaagatttatttttgaattttgtgaatgtttatgttttaaaggaagtttttttttttttttttttttttagaggtagggttttgttttgttatttaggttggagtatagtggcgtgattatagtttattgtagtttttaatttttgggtttaagtgatttttttgttttagtattttgagtagttaggattataggtatatattattatatttggttaattttttttaaatgtttaaaatattttttaaagattttatgagatgggattttattttgttgtttaggttgatttgaaattcgtggtttgaagttatttttttatattggttttttaaagttttgggattataggtttgagttattgagttttggtttaaagggaattaatttaaatgtattaaatatagaattatagggtttatagggtttttttataggtttttatagatatatttttaaattttaatagtttgggttgtatgtttgatagaaattattttgaaaatagtataaatgttggtgagaggttttgatattttagtttatt

SEQ ID NO: 255 - DNA, 6001 bp, Artificial Sequence
  chemically treated genomic DNA (Homo sapiens)
ggtaagttgagatgttagaattttttattagtatttatgttatttttaaaatggtttttattagatatgtaatttaagttattaaagtttaaaaatgtatttataaaggtttataggaagattttataggttttgtaattttatatttgatgtatttaaattagttttttttgggttagggtttagtggtttaagtttgtaattttaaaattttgggaggttaatgtgggaggatggttttaggttacgagttttagattagtttgggtaataaagtgagattttattttatgggatttttaaaaaatgttttaaatatttaaaaaaaattagttaggtgtggtgatgtgtatttatagttttagttatttaggatgttgaggtaggagggttatttgagtttaggagttggaggttgtagtgaattatgattacgttattgtattttagtttgggtgatagagtaggattttgtttttaaaaaaaaaaaaaaaaaaaaaagttttttttgaaatatggatatttatagaatttaaaagtaaattttattaagaatattaatgttaatttttttgtagtttaataattttttttgtatttttaataatatttagaaaaaaataaaggaaaatagggttatttaaatatgttttgtattgttttttttttgaatatataaatttgacgaggggataaggaagggtttatagtgaggtttttaggtttttatttttatttatagttagttttttttttttttatgtttataaagttagcgattatgtaatttatatataaggtaagtatgaaattaggtaatgtgattgatgttgatatattttttttaaaggttcgaatttatcgattttttagaaaatgttttttttataaattttatttattatttttttaaagttaaagtaaagaatgtataaagttttgggttaaagggataacgataaaaaaattatgtttagattatataggtaatttaatttttcgattttttttggtttaaggtgttagattgggaagcgtggggtgggtaggaagaaggaagagtttgttgtgaataagattcgttttagggtgttgtaataagattggtataatgttgataattgttgagttttagagatgggtttttggaggtttattatattatttttatttttgtgtatgtgaggatttttttaataaaaaataaagagaaaaagaaaagttttaaaaatgaatataaaataagtgtaaaagtaattagttagagaaggtttatagataggaggtatttttttttttaagatgtttgttaaggagggtattattaaaatatagttataatttaaattggattgtaatttgttttaaaaaatagtattttaataataaagaattagataaggtcgggcgtggtggtttacgtttgtaattttagtattttgggaggttaaggcgggtagattatgaggttaagagattgagattattttggttaatatggtgaaatttcgtttttattaaaaatataaaaattagttgggtttggtggtgggtgtttgtaattttagttatttaggaggcggaggtagaagaatcgttggaattcgggaggcggaggttttagtgagtcgagattaagcgattgtattttagtttcgtgatagagtttgattttttttaaaaaaaaaaaaaaaaaagaattagattaaaaaaaagattgttttgacgattgggtttaagaatgtgttattgttttttgaaatgttggatgtttgttagtattagttgattaaataaaatagagtgaatttttttttttagtaaagagaaatatttatttgtgaataatttttgaatttgtttttgagattgtattttttttatagatagtatttattgaaaatagttttataaaagtttataattaaaataattataaatagttttaaagatttttattgaaaaattatatttttttaatttagtaggtttttttttttttagttgaagaatgtattgtttttgtggattataattaattttttttttttttttttttttttttttgttaagagatagggttttgttttattatttagtttggaatgtagtgggataattatagtttattatagttttaaatttttgggtttaagagatttttttattttagttttttgagttgtttggattataggcgtgcgttattatatttagtttacgattaatttttttaatgaaatagaatagattagagtaggatagaatataaaatagtgtatgttataggtaattaggttatatattattttataaggtatttatttttgttataattgaatgtgtatattttgttattttgtaaatatgttttttattgtaggttatagttaaaagaagtttgaaagtttttttaatatttataatttaattaaattaaggaaatatataaaaagtaatatttgtttgtttttttatttttttgttttttaggttatatgtagtttaagggtaaaaatttttttagaaaaattaataataaataattgtattattgatgataattgttattataattatagtaataaattaataacgaaatatatagggaataaacgttgggaatattttaaaatatggggggtgtaggaggaggttataggaaatatttttatagttggagtagggaatttcgtttaaaatgaattgtaattattgagaaaaaataagttttgtttttttagttattgtgagcgttgtttttagaaaagtaagaagtttttttttttttaaaattggattttttgtttttattataatatagaggaggttttgttttagggagatttttattttgtttaataattgataattgtaaaatatttggttatgttttatgttgttttaatatattattagttttattttggttagaaaaataaaaatttaacggcggcggtagtcgtttgataatgggtttaaggtatatcggagattttgttttttttattgcgggtggggttggggacggtgggtttggcgggggaggggaggagtcgggttggggtttgggaaggtagagagtgagttttattagtaagatttgattgtggttcgggagagaatttaattattcggtttattttagaacgaaatgaatagggaattgggttaagtagtttaaagtttattagagttagaatattcgaacgtttttaggggataagtaggttaaaaaaaggaggggggtggggagaaaggttttaggaaagggtaggttttatgggggataaggaggggaaagttggattgaaggtttttaaatttatatttttgaaaagtagtgtttttaagtgttggttaaagtaaatattggtgtaaggcgtaggggggtacgtatacgcggatttttaagtttgtaattttttttagttaacgtgatttattgtatatgtaaaatttgttatcggtttattttcgtttattatttatttatattatgtttatttatgtattcgttttatattgttcgggttcgtcgtatagttgcgcgaggcgaaggtagagattagagttttttttttttcgtttcgttttagttttcggatcggtttaggagatggtatagttcgggcgtttgtaggtgcgtggtatcggcgggatagtaggtttcggttagttgagtcgtgtattgtttcgtattagtagttagggttaggggtagttgtacgggtacgtttcgtcgagtttttttattaattgtatttttttcgaagttcgtttgtcggagttgttgatttcgttgtgtacgttgatgtaaagcgtttaggggatttaaggtagggagcgggaattcgattgttatacgtagggatgtaaatttattcgcgtgcgtgttttcgtttgaattttattttcggcgttcgttcgcggggatttattgagtgcggtagtttggcgggattaggtttaaagttgattatttgtttgggggcgtttatggtgcggcggttagggcggtgagttagttaaggaggatcgaacgcgtgaacggttggcgtttttggtcgttgcggtgagagtttgtagtcggtttcgaattttcgttttgtttttgcgtcgagtcggcgttttattggttcgtgttgtcgtaggttttgcgttaattggttcgcgcgaaggagtttatatttttattggtcgcgtttttgagtcgagtcgaagtagttgttttttttcgcgtttattgttttaatttttatttttgattaatgtaaggagcgcgcgagattgcgttagttagtcgagtcggttcggttgcgcgttcgttcgaggattgtgggcggcgggaagaggttgtttttgttaatttgttttcgttttttgagttcgtaatttggtcggttttagttttttaattttagaggattttagttttttttttttggttgaaagggtagttgtcgagtagatttgtagtttttatttatttatttttttattattagtttttagtttgggttgtgatgtatttgttttagaattattagttattaatttattaaatttttttaagtattttttacgggcgttagatattttagtggagagagaggatttttttaaggttggaagcgtaggatgaagaagggtcgggggtgggtggatacggttttttgtatttgtacgtgggttttgagtttttgtaggattaaagaacggaggtggttaaggacgtagggaggagcgatagtttgggaagcgtggatgttcgttaggtaagttttttaaagtcgttgattttttatttttttttttgggaaacgagtgagttggaaatttgcgatagtttttaggttgcgttcgcgttgataagttgtgagtttagaaacgtgaggagatattaataagaacgcgatatttatagggcgttgtagtttaaattagaagaaggtggtttttagttaggttaggcgtagggttagagttgtttaaatttttttatagaagtgttttttttaaaagaattttagtggagattcgtatggggttttgaaatagaatattttttttttattttgtaagaaagaagtttttttgaagtttggaattttattatttttaaattgtgaattttgtattttttattataatttaatttagttttttttaatgtaaaaatattttttttgtttgagtaaaattgatgcgttaggaatatatatagtttaattgtttcgtttagagaaggtttgtaattggataggattttggtttttgtttgttttttttaatgagaatgtgggcggtatggggttgagagtagaggtattgttttggatttgggaattggaggataaagtttttagaaaaaggtaaaatgaataaggtttttgcgttttttagtaattttattaagaaaatcgcgatatttaagatagaataaattttagtttagaaatttaggtatgtaagaagtattatatatttattattttacgtaaataatttagttattatatattagtagttgtttttagtagtttatttattggagattaagggagttagtttttattttttttggagttagtttttaatattagggttatatatagttttatgtagtgggttgggagaagggatagtatatttatttggttttttgtttttaaaagatatggttgagttgtttttattgtttaagttgatgtggttgtttgggttgatgagtaatttattatttttgtattttattaggggtataggaatttggggtggggtggcggtggttattgttttatttgttaagatattttttgtagttatttttttcgggggttttgtagtttttaagatggtattttagggatataagttatatatatagttagttttaggatttattgatttttgtttgtttttttttcgtttttgggtaattttttttttagtttagagaaaatttgttttttttatgttttttttttatattgtgttt

SEQ ID NO: 256 - DNA, 4001 bp, Artificial Sequence
  chemically treated genomic DNA (Homo sapiens)
ttttattttttttatatttgtgttatatattaaaaaattatatattagagaatttaaaagatttgttaaagttgtttagaaagtgatttgatgttaagatggtgtttttttatttgtattatttttatagtttagaagtatattattaatttatgtttttttttataatttggagttatatatggattatgttgttttagttattttgtttaatttgatttttaatattgttattgattttatttttaagtgttttattttaaattatagagtgttaaagatgttggattatttttataatgttatttttaagtttggtgaattaagaaattgttagattattttgtgtaatattataatggtattgttgtaatattatatgttaaatttagaatgtgtaaagattagaagttgatagtaaattattttaggatttataatttgtaaaaatgaagtttggtgttatgaattatgttgtttttaaaagaaatgtaagtttatttttgtaaattttttttttgagaaagtagattattttgatgtgtttttaagtaagacgtatattattttttaagttagttatttttgttatttagtttttattttgagtttttatgtaaatttgggttttatattaaaaagaaatgtatattgtaattgaaaatttgttttggaatataattaattgtttttttaatattttttttatatattattttttttagtaggaaatggtaaggaatatgatttatttaaaattttaatgatttttattgtaaaaaaaataataaatttaagaaaattaaagttgaaattaatatgaaaaattacgaattttttataaatgatgattatttttgttttttttaaataatttaagaatatagtaatgtattatatgtaatttggttgattaatattatgaataattgaattggtattaagttaagtaattatttaaaagatatttttagaaattttaaaagattttttttttaaagtaaaatatttgatttttgattgggaaaaagattgaagagtttaagaaataaaatatttatagagatgaaagggagtttttgtatttttaagggatttatatagtgttagtttatagttttttatacgtgtttatagtttattttttaacgttaataaggagggataaaaaaggttttttattttttagtgtttattttttaattagttattaattaatgttaatgttaagataattaaggttagttgtaaaaaagtttttagaaatttattggaattaattaattagatttgggtaagtgatttattattgtaaatttatgaataatagttagagaaatattattaattttgatttttgtagtattttattaaagaagaaaaatgaaaataacgatatttaagaaattttatgttattatttaagtttgtatgagaatatttatttaaaagataattagaagttatagttatttagttgaataagtgaattattttattatgggttagtttgaagatatagttatatattatttaaaaatggataataaaataatattataatgtttatttgttttttgtttggtttttggaagttatttaaaagaacgtttttttaatgatatatagtaatttttgaggaaaatttttagattttgataggtatttaagtattttagtaggagatattgggtttttggtttttgttagataatattttattttatgattatagttaaattttatagatttttttttaatttaattataagtgttgaaaagagaatgagtaaaagtttgttttagtttttattaaggtatatgtagagattttggaattttttttatatttttaaatattttattttttaattaaagttttttaaaattattttatttatattatttttttttgggttttttgtaggatgtgtttagggcggttgattgtggattcgaagagggattttagtttcgttttatgagtttttagtaattgtagttaatgaagtttttatttgtttttatattagtagagtgtttttatttgtatttaagttttgggattaataggaaattttatttaatgattgaagggtatttggtgtaattattatgacgttaatttttattatgacgttaatttgattttattttgttttaatttttaggttatttttgtttggagttatttttaggtgatggtgacgataaggttagtttatgaaaagagagtacgttgttattttgtacgtaattttattgagttatatatataatattttgaaagttgatatttttttataaataagagatatttaattagttaagtatttgatatttatttaaataagagttatagattttcgaaaatagatatagagtatttttaggtttatattattatttaattaggaaatagaaaaataaaatatatatttatttagatttttttaaaattaatttgtatttgaatttaataaagatgtatgagaaaggtatgaggtaattttaagaaggattgaatggtttttaatatacgtgtttggtttttggttttttttttttttttattttatttttgtaaagtttagtttttgtttgaatagaaaatatgtatgttatggtttgttaggtgtgggatatttagttttaaggtttttaatttagtgttattttaaaatttgtatagttttttagattattgtggttttttttttgtatatagagattatgattttttaaaagtttttatttttatttatttcgtttagtgttattttcgtaaggaattggtttagatatagattattaaggatttttttaataaagagtttagaagatttatgtgatgtaaaaagtaatttttgtttaatataaagaaatttgttaaagaacgtaaagttgttttgtgatttattttttgtgataaataaatttgtttaggtttttatatttttttagattttcgttgtttttttttagtatgtattttaattatttatttttttttagtgatgtttttttttgggggacgagtgggggagacggaatttcgttttgttttttaagttggagtgtagtggtataattttattgtagtttatatttttcgggtttaagtattttttttgttttagttttcgagtagttgggattataggtgtgcgttataatgtttggttaatttttgtatttttggtagagataggagttttattatgttggttaggttggtttaatttttgattttaagtgatttatttatttcggtttttaaaagtgttgggattataggtatgagttatcgtgtcgggtttttttagtgatgattgatgttattattatttaagaatttttatatttaaatattaattaattggtagtatatttttaatgtagtagatttattttgaaaatttttttatttaggtattttatttttttttgttttatttttttttttttatttgtgttttttttatatttttttattttttttttatttgaatgattatatagaaataatgtttttaggatgtttttattaaattatttttgtttggtttatgattttatagtggattttatttttattttatatttttatataagaattatgaatattagggaatttttatgaaaatgtttattgtgtttttaaagtttatatattgttttttaatttttttagtgatgtggttatataaataatataaaagttagtgtttttaatatttgatttattttttttatttttttaattattttatttagaagtaatgtttttagttttttatttgtgtttttgtagatattttatgtatatataaataaattatatttaagtttttatttttgttgaaattttttttaaaataataaatagaatataaaaattagaggaatttttgtttttgtgtttagagaatttttgttggtatggtataaattatatttttttgtattttttataataaatatatattatttttataatt

SEQ ID NO: 257 - DNA, 4001 bp, Artificial Sequence
  chemically treated genomic DNA (Homo sapiens)
aattataaaagtaatatatgtttgttgtagaaagtatagagaagtataatttatattatattaatagagattttttaagtataaaggtaggggtttttttaatttttgtattttgtttgttattttaaggagaattttaatagggatggagatttaaatataatttgtttgtatatatatagagtatttgtagaaatataagtaagaaattggaaatattgtttttgagtagaataattgaggaaatggggaagataagttaggtgttaaaggtattgatttttgtattatttatgtagttatattattaaaaaaattaaaaaatagtatgtaaattttaaaaatataataaatatttttataagaattttttaatatttataatttttatatagaaatgtgaaataaaaataaaatttattatgaaattataagttaaataaaaataatttaataagagtattttagaaatattgtttttatgtaattatttagataaaaaagaaataaaaggatgtaaagaaggtataaataaaagagaaagaatagaataaagaagagtgaaatgtttagatggaaagatttttaaaataagtttgttatattgaaaatatattgttagttggttgatatttaaatgtagaaatttttgaataatggtggtattaattattattaggaaggttcggtacggtggtttatgtttgtgattttagtatttttggaagtcgaggtgggtggattatttgaggttaggggttaaattagtttggttaatatggtgaaatttttgtttttattaaaaatataaaaattagttaggtattatggcgtatatttgtagttttagttattcggaggttgaggtaggagaagtgtttgaattcgggaggtgtagattgtagtgagattgtgttattgtattttagtttgggagatagagcgagatttcgttttttttattcgttttttaaaaaggagtattattaagaaaaggtgaatggttgggatgtatattggaaggaaataacggaaatttgaaaaggtgtaagaatttaaataaatttgtttattatagaaaataaattataaaataattttgcgttttttggtaagtttttttatgttaaataagaattgttttttgtattatatagattttttaaattttttgttgaagaggtttttggtagtttgtatttaagttagttttttacggaagtggtattgagcggagtagataaagataggaatttttgaagggttataatttttgtgtgtaaaaaagaagttatagtagtttgaagagttgtgtaggttttagggtgatattgggttgggaattttggagttaagtgttttatatttggtaagttatgatatatatattttttgtttaggtagaaattgagttttataaaagtgaaatgagaaaaaaaaaaaaattaaaaattaggtacgtatattgagaattatttagttttttttagaattgttttatattttttttatgtatttttattaaatttagatgtaaattaattttagaaaagtttaaataggtgtgtgttttatttttttgttttttaattaaatagtggtataagtttggaaatgttttatatttattttcggaaatttatagtttttgtttaggtaaatattaggtatttagttaattaaatgttttttgtttataggaaagtgttagtttttaggatgttatgtgtatggtttaataaaattacgtataaagtgatagcgtattttttttttatgggttgattttgtcgttattattatttgaaaatggttttaaataaaaatgatttaagggttgaaataagataagattaaattgacgttatggtaaaaattgacgttatggtaattatattaagtattttttaattattggatggaattttttgttgattttagggtttagatgtaggtggaaatattttgttggtataaaagtaggtgaggattttattaattgtagttattgagaatttataagacgaagttaaaattttttttcggatttatagttaatcgttttgaatatattttgtaaaaagtttagagaaaggtaatatgaatgaaataattttgggggattttaattgaggagtaaaatatttgagaatatgaggaagattttaaagtttttgtatatattttaataagaattgagataggtttttatttattttttttttagtatttatgattgaattagaaggaagtttgtaaaatttggttgtgattatagggtaagatgttatttaatagaagttagaaatttaatgttttttgttgagatgtttgagtgtttgttaggatttaaaaattttttttaagaattattgtatgttattggaaagacgtttttttgagtggtttttaggagttagatagagggtaagtagatattatgatattgttttattatttatttttaagtgatgtatagttatatttttaagttggtttatgataaagtggtttatttgtttagttgaatgattatagtttttgattattttttgaatagatgtttttatgtagatttgaatagtagtatggaattttttgaatgtcgttgtttttattttttttttttaataaaatgttataaaaattaaagttggtagtatttttttagttattatttatgaatttgtaatgataagttatttgtttaagtttaattgattagttttaatgagtttttggaaatttttttgtagttaattttggttattttagtattagtattaattggtggttgattgggaaatagatattagaaaataaaagattttttttgtttttttttattagcgttgaagaataggttatgggtacgtgtgaagaattatgggttgatattatatgggttttttaggaatgtagaagtttttttttatttttgtagatattttgttttttaagttttttaattttttttttagttaaaagttagatattttgttttagaaaaggaattttttaaagtttttgaaaatattttttaaataattatttgatttaatattaatttaattatttataatattggttaattaaattgtatgtaatatattgttatatttttgaattatttaaaaaagataagagtggttattatttataaaaggttcgtggttttttatgttaattttaattttggtttttttaagtttattattttttttgtagtaagagttattgaaattttaagtgagttatattttttattattttttgttgaaaagggtagtgtgtgagaaaaatgttagaaaagtaattaattatgttttagagtagatttttagttgtagtgtatatttttttttaatgtgagatttaaatttatatgaaaatttaaagtaagagttgggtaatagaaatggttaatttagaaggtaatgtacgttttgtttaaaagtatattaaagtaatttatttttttaaagagaaaatttataggagtgaatttatattttttttgagaatagtatggtttatagtattaaattttatttttataggttgtgaattttagagtagtttgttattaatttttgatttttgtatattttggatttggtatataatgttatagtagtgttattgtaatgttgtataaagtagtttagtaattttttggtttattaggtttagagataatattgtagaaatgatttagtatttttaatattttgtggtttaaggtggggtatttaggggtagaattaataataatgttagaaattaaattagataagataattgaaatagtatgatttatgtgtgattttaagttataaaggaggatatggattaatggtatatttttaggttataggggtagtataagtggaaggatattattttagtattagattattttttgagtaattttggtaaattttttaaattttttaatgtgtagttttttaatatatgatataggtgtaaagaaaataaag

SEQ ID NO: 258 - DNA, 4418 bp, Artificial Sequence
  chemically treated genomic DNA (Homo sapiens)
agattttacggaaggggatagggagtcgggttttttataggtatttgttgagaaaggtaggaaggttttcggttttataaagtggttttgggtatttaggaagtgttcggggtggaagcggaagggttttttttagacggttttattttttagtatcgatgataggttggtgatgagtgtcgttttttgggtaggagatgtagggtgagagtggggattggattttaggatgttgggatttttgttattaaatatacgggggatatatattgtttggtatatagttggattttgttaattagttttgcgttcgagaagttttatagtatttttttcgattttatagtagggcgtagttatattttttagaggtatttatattgttttttttttttgtaggcgttgggttttttaatattttggtaggttttgatttgttttttttattagattggggttttggatggataggttagttttgtttatattttggattttttatttaagcggggatagttagtgtggtggtattgaggattaggtggttagggtttttagagtgggtttatttggtagtagttatgttggggttattattaggggttggtgttgagttggggtgaggagggcgttaggtttattttagggatgcggaagttttgtatttcgatgttacgggatgttatatgggttatatttagggggatgatgtttttaaagcgttgtatttcgtgaattacggtagtggtgtagggtatgtgagtttggttatttatttttggtcgtcgtatttgttttattacgtcgtcgattttttgttggatacggattggatagatatgcgtttttataatgggttagtatttaggggatattttttttttttttgtgttggaggaagttaggtttataggagtttggttacgtttgtgttggaagtttcgggtgttttagttaagtttaggggtttttagttgtatttttttttttttagtttttgttttgggttttagttgggtttacgttgtatatttaggtgtaggattatgagtaggaggttttaggttagcgtggtcgaggtggttattatttcggtaaggaataggttatttattattatgcgtaggtttttattattgaagttgtttttagggttttttttggtttgagtagggtcgagaggatatttaggggatagaacggggtagtttttaaatgatttttaattttgtatttgttagtttagatgcggttcgtcgggtgatgtattggtttaattttttgtttagtttttttttattttttttgggacgtttaatttattatttttgttttttatcgtggtagttatttttattttttttttttttgttaggaaggttttagttaggtttcggggtggttgggttgggttttaggttattttgtgtttagttagtagtttatttagttgggttaggaaagttttttggaagcgtaggattttgttagttagcgttgggatgtgcgggaggacggggatagtatttagtatttatattagatagaacggggttttaattttttttgtgttttgcgtttatttggattagttttaggttttagttatttttaggaagatttagggtttgtttgtttttattattgattttattaagtttttttttaagtgttagtttttattttttttttttttgtttagaggagaaatttaaaatcgaaatttttaacgtggacgggggtatagagtttttggttttttttggtgttttttgattcgggtatattttttttacgattatgtttgagatgttttttttttttttaggttttttttatagtggggttttttggaatgtttttttttaaatttatttatgtaaattttgtttttcggaggttttagtttagtttcggtattttttaggagttcgttttgtagagatttttcggtttttcgtttcgtatttcgcgtaggaagttcgattttttttttagttttttttgagttaggtttagtagtttgaggaagcgagggtcgtcgtattcgaagcggcgttcgtaggtgagggaggcgattacgttgtttacggttttgtttaagaggtcgttggggcgaaaggggcgttttgggggtgggagatgcgggtaaggggttgtttttttcgtttttcgtttttttagttttcgttttgtgtttttttgtttattatttatcggtttggtcggcgaaggcggtataaaggtaggcggttttttcggttatttattgttttagcgattttttgtttaggtttaagttgcgtaaggtggatacggagaagcgtttttgttcgcgttacgcgggtttatagcgcgataggattatttttgggggcgggacgggtacgtgggcgttgttatgaaggttttggttttatttttcgttatttattttaattttggcgttttataaggtttttcgtagtttttagttcggtttagttgggtatagggtttattttttgtttatttatattgtttttttgtttggggcggggtttggttttatttcgtttttgtttattttgattatttttttatttaaggaagatttcgttcgtttcgtttatattgagttcgtagtataggcgcggttttcgttatcgttatttcgacgtattagtttcgtttatcgggtttttggcgggtttgggtagtagtttcgtttttttttagtttatagattcgtatttttttcgtgtaggtggttttttggtttattgtttttagtttattcgttggtttttatttttgttttacgtttaggattttacgttttgtcggcgttgtttgggttacggttattgtttattcggggtttacggaaacgcggtttttgttttttatcgtcgtttgttttgggaacgcggttcgaagtttaggatttggtagatgggcgtaggcgggcggtcggtcgtgttttcgtcgcgggttattatcgtttcgcgtacggtcgttagtttattgagtacgattatcggcgtttaggttagttgtaggttgaatacgttttcgaagcggcgtcgtaattgtagagggagggttagggttttttgttaagttaggattattttagattataggttttagttttatttgaattttggacgattttcggggttattaggagtgagtaggtggaaggaggagatttagttttttgattttggggcgggggtgggggttatattttttgtgatggaggaatttagtttggatgcgttatttaggtatgattttgtaagagttattaaaattgtcgagaggttttagttagtattttatttttagatgatggtttatgtcggtgagtagtgaggttcgaggatttatagtgtaaaaggtttgaatcgggttattgtattttttttattttcgatttcgtgatttaaacggtatttaggattaatttattttttatttttaaggtttttttttttggtgttagtagaagggattttgtattttataatatatgttgtttaatgggtttgtatgtttattgttaagtttagttttatttttaggtttttgttttatttttttttggtttttggaaaatttagttttttatgttatgtataaatgtttttttttaggacgttttttaaatttgttttttttttttagtttggtttttgatttagtttgtggtttaatttattatttatgtttgttggtggtggggtatttttaggatttttgtcgttttttaggatttttttttttatttggtcgaagtagtatggtgtgttttggaagtttatatgtagtaaggttgtttagttcgggtagtggtaggggatttggcgggtagcgtgtagtttagcgttggtgtcggtgtattaggtttattaggagtaggaagatggttattattatggttaggggtattagtgtttttagttttatggttgttttattattaattgggtttttttggatatatttggtatttttattttattaggtatagaggattaggtaggatattttcggtatatcgagcgcgtgattttttttttataaagggagttgatgatggttttcgttttttgttgtgagtgaatttgttgtgttgattgtgttgttagtggtagagttaggttagggtaggtatgggttgttttagaggtttttgtcgttgttttttgttttaggtttttatttagggtagggtggtagaaaggtttggtcggagaagttattttttttttttattttaagttttttaagtttatataggtttttgggataattagggttttagtggattcggttatttattttttagttaggtttatatattttaatgtagttataattttttttttagaatatgattttgttttttttttatttttatttgtttattt

SEQ ID NO: 259 - DNA, 4418 bp, Artificial Sequence
  chemically treated genomic DNA (Homo sapiens)
gagtgggtaggtgggggtagggaaagggtaaggttatgttttggaggaggggttgtgattatattagggtgtatgagtttagttgggaggtggatggtcgggtttattgagattttggttattttagaagtttgtgtgggtttggggagtttggagtggggagagggggtgattttttcgattaggtttttttattattttattttgggtaagggtttggagtaggaagtagcggtaaggatttttggagtagtttatatttgttttggtttgattttgttattggtagtatagttaatatagtaggtttatttatagtagagggcgaaggttattattagttttttttataagggaagggttacgcgttcggtgtgtcgagagtgttttgtttggttttttgtgtttggtggggtgggggtgttaggtgtgtttagaggagtttagttggtagtgaggtagttatggggttagaagtattggtgtttttggttatgatagtggttatttttttgtttttggtggatttgatgtatcggtattaacgttgggttgtacgttattcgttaggttttttgttattgttcgggttgggtaattttgttgtatgtggatttttagaatatattatattgtttcgattaggtgagggaggaggttttggagggcggtagaggttttgaggatgttttattattagtaaatatgggtggtgggttaaattataggttggattagaagttaggttgagaaggggaagtaggtttgggggacgttttggggaaggatatttatatatggtatgaaggattggattttttaaaggttaaggaagagtagggtaagggtttggaggtggagttggatttggtagtgggtatgtaagtttattgggtaatatatgttatggagtataaagttttttttgttgatattagaaggaaaggttttgggaatggaagatgagttagttttgagtgtcgtttaaattacgaaatcgaggatgaagggggtgtagtgattcggtttaaattttttgtattgtgggttttcgggttttattgtttatcggtatggattattatttgggaatgggatgttaattggggtttttcggtaattttggtgatttttgtaaggttatatttgggtgacgtatttaaattgagtttttttattatagaaggtgtgatttttattttcgttttaggattaggaggttgggttttttttttttatttgtttatttttggtagtttcgggggtcgtttaaggtttaaataggattaggatttgtagtttggggtgattttggtttgataagaggttttgattttttttttgtagttgcggcgtcgtttcggggacgtgtttagtttgtagttggtttggacgtcggtggtcgtgtttaatgggttggcggtcgtgcgcgaggcgatggtgattcgcggcgaggatacggtcgatcgttcgtttgcgtttatttattaggttttgggtttcgggtcgcgtttttaaggtaagcggcggtgggggatagagatcgcgttttcgtgggtttcgggtggatagtgatcgtagtttaagtagcgtcgatagggcgtggggttttggacgtgaaatagagataaaggttagcgagtgggttgaggatagtgggttaggaaattatttgtacgggggaggtgcgagtttgtgggttgggagggggcggggttattgtttagattcgttagaagttcggtgggcgaggttgatgcgtcgaagtggcggtggcggggatcgcgtttatgttgcgggtttagtgtgggcgggacgggcgggattttttttgagtggaaaggtggttagggtgggtagagacgaggtggggttaaatttcgttttaggtaggggagtaatgtgggtgagtaaagagtgggttttgtgtttagttggatcgggttagggattgcgggagattttgtggagcgttagggttggagtgggtggcggagggtggggttaaggtttttatggtaacgtttacgtgttcgtttcgtttttaggggtgattttgtcgcgttatgggttcgcgtggcgcgagtagaggcgttttttcgtgtttattttgcgtaatttgggtttgggtaagaagtcgttggagtagtgggtgatcgaggaggtcgtttgtttttgtgtcgttttcgtcgattaagtcggtgggtgatgggtagaagggtataaagcgggaattgggaaggcgggggacggagaaggtaattttttattcgtattttttatttttaggacgtttttttcgttttaacggttttttggataaagtcgtgagtaacgtgatcgttttttttatttgcgggcgtcgtttcgagtacgacgattttcgtttttttaggttgttggatttagtttaggagggattgaaggaggagtcgggttttttgcgcgaggtgcggagcgagagatcgaggagtttttgtagggcgagtttttgagaggtgtcggggttggattggggttttcgaagggtaggatttgtatagatgggtttgggaaaggatattttaggagattttattgtaagaagggtttggaggaggaggggatattttagatatggtcgtgggagaggtgtgttcgggttagggggtattaggagaggttaaggattttgtattttcgtttacgttggagatttcgattttaggttttttttttgggtaaggagagagagggtggaggttggtatttggggagggatttggtgaggttagtggtaaggataggtaggttttgggtttttttggagatggttggggtttgagattggtttaggtgaacgtagagtataggagggattgagatttcgttttgtttggtgtaggtgttgaatgttgttttcgttttttcgtatattttagcgttggttggtaaggttttacgtttttaaaaggtttttttgatttagttggatgagttgttaattgagtataggatgatttgggatttagtttagttatttcgagatttgattgaggtttttttggtaaagaaggagaaggtgagagtggttgttacggtggggggtaagggtggtgggttgaacgttttaggaggaatgaggggaggttgggtaaaaggttggattagtgtattattcggcgagtcgtatttgggttgataggtgtagaattggaggttatttgggggttatttcgttttattttttgagtattttttcggttttgtttaggttaaggggagttttgagagtagttttaatgatgagaatttgcgtatagtggtgggtaatttgttttttgtcgggatggtgattatttcgattacgttggtttggggttttttgtttatgattttatatttggatgtgtagcgtgagtttagttggggtttaaggtagggattgagggaggaagggtatagttgggggtttttgggtttagttgggatattcggggtttttagtataggcgtggttaggtttttgtaagtttaattttttttaatataggaggaaggagagtgttttttgggtgttgatttattgtggggacgtatgtttgtttagttcgtgtttaataggagatcgacgacgtgatagggtaggtgcggcgattagagatgggtgattaggtttatatgttttgtattattgtcgtgatttacgaggtgtagcgttttggggatattatttttttgagtgtgatttatatgatatttcgtgatatcgaagtatagggttttcgtatttttaaggtaggtttggcgttttttttattttagtttagtattagtttttggtgatagttttagtatggttattgttaggtgggtttattttaggaattttggttatttagtttttaatgttattatattgattgttttcgtttggatggggggtttagagtataggtagggttggtttgtttatttagagttttagtttagtggggaagataaattaggatttgttagaatgttggaggatttagcgtttgtagggagagggggtagtgtgggtgtttttgagaggtgtgattgcgttttgttgtggggtcggagagggtattgtggagtttttcgggcgtaggattagttgatagagtttagttgtgtgttaggtagtgtgtgtttttcgtgtgtttggtggtaggggttttagtattttagagtttagtttttatttttattttgtattttttgtttagggaacgatatttattattaatttgttatcggtgttgaaggatgaggtcgtttggaagaagttttttcgtttttatttcgaatattttttggatgtttagggttattttgtgaagtcggaggtttttttgttttttttagtaggtgtttgtggggagttcggttttttgttttttttcgtggagttt

SEQ ID NO: 260 - DNA, 4398 bp, Artificial Sequence
  chemically treated genomic DNA (Homo sapiens)
ttgttttaaaaaatattttaaaaaaataaataaaagaatatttattattattaatagaataaattgtgatatatttataaaatgaaattttatagaagaataagaggataaaaggaattaattattgatacgtataatacggattaattttaaaaatattttttgagtagttagatacggcggtttatatttgtaattttaatatttttagaggtaaaagtaggacgattatttgagtttaggagtgagtttatagtgaattgtgattgtgttattgtattttagtttgggttagagttggttttatttatatgaagtttaaaaaaaggtaaaattatttatttatgatgataaaagttagaataagaaggtggtagggattgatagagggtataagggaattttttgggatgatgtaatattttgtatattgagggaggtgtggttatatagtatatgggtttgtttaaatttattaaattgtaatatttaatatttatatattggagaatatattttatagaagtagatgatagaaatggttatttttttatataatttgtaaaagaagtgtaatattgttgattattttttttttataagttattattaattcggttttagtgagattatattggtttttttttttattcggattattttttaaatatattttttttttttattttttttttatgtttttatattttaattataatttaattttttttttttataaattattatttatgggttgaagatatttaagtttattaaattttatatttaaaaatttagttgttattaagtatgatatattataaatttaatatttataaattttaaatttttttttttcgtttttatcgtaatttttttattaattttcgaaaaaaaaaaaaaaaatttgttttttttatttgagattagaattatttgtttttgtttttagagatagggttttattatgttgttttaggttgattttaaatttttgggtttaagcgattttcggtttcggttttttaaagtgttgtgatttataggcgtgagttacggtattagatttgaaattttttttaaatatttgttttttgggtaagttgtagtgttttatagaaaaaggaaatgaagtaatagtaatggagtattttttatattttatttgggttttttattattgtagtttaattgcgtattttatcgatattttttatatttttttagaggattaggagggaatatattattttagatagtttttggtgaatagttaatatttatttagaattaattatttgtttaaattgttagttatttgatatattttatttaatgtgtattaacgtcgttttggatgaaattgagtttataataaattaaataatttggttaaggttatataattaaagcggaaaacgttatgatttgaaaaggtacgtttggggttttaaaattttttatgtttatttttaatatatgttggagagttaaattttaattggtagaatttgcgtgaaatggaatattttttagataatttaaataacgagtatttgttaaatattttataatcgggaaagtgtaatttcgttgtatgtaatttttttttttggacgtgttaagtaatttgttaaattttttaatttagattatagttttttaattttttgtattatggtttttttaaacgtttttatagtttcgcgttttttaatttcgagtttaagtgaggttgtttatggggttttggtagatgataaacgataaggaggtcgaaagttagatgttttcgaattgagggagaaggtcggatttttgattcgggttatattggggatttttataaattattttttttagataagtgatttcgggggttattttgatttttgtagtgagttagattaaatttttacgttaggttagttttcgttaggtgagtaggtatataaaaagaagttttagtgattatcgtacgttggtgtggagaggtttcgggaggtgtaaggagaatagagacgaattcgatcgcgggtagaagttttttttggttttaacgtcgcgattgtttgtcgtcgaggttagggtcgttattttttatgttcgagttggttaggcgttattcgtatttgcgggttataggttttcgaagtttatgtttttgttaatttttgcgtgaagttattaaatttgtagtatatgacgtttagagttcggtttttcgtattcgttgttaacgcgatcgttttagagaaggatttcgttttttcggttgtggtttcgagatttagcgtaaggattcggtgttgggattagggttgttcgaagatcgtttaatttaaaatttgtatatttaagtcgtattggggaattaaaagttagggtttttaggattacgaaaggtaaaattagttttaagagagtacgtaaagtcgttgtggcggagtttgtaggaaatatgaagtttttttttttttttatttagatttgggtagtgttacgataatttaagaaatgcgtaagcgttttacggattaagttcggcggattaagttcggtagtgtcggagttaggtggagtatgttttaggaggggcgggttttaggcggggtttgggggggagagggcggtgattggtgggcgtggtttgggtaggggcggggttatatcgaagtcggttgggaattttattattcgagagagtttgtgttgcggagttatcgtttggtcgtcgggttgaaggcgttttttgttttatcgaattttaattgatcgtagttttatttattttttttcgatttagagtattttttatttagaagttattatttgttgttgtttagtttgtttaggagtatagatttgtcggttaagttttttttggtaatttgggagttgaagtaaataagaaaatttggaagtatttgttgaaggttgtttagtatttagggttgttgggagatttgttttaataatataaaagtagttttttgggttttgtgtagaggaaatatatatgtagagtgatttaaagtttaggtattaggatgtaaatgttatacggttttttagaattggtttttatttttatttgagttttaaggttattgattatttattttttttttggtttttgttttttgcgataaatgaggtagggggagggtgattagaaatatttgtaaaatttggattttgagtttgaaagatttggaattattatttttagttttggtagtattcgttttagtttaatttaaatatgtttgttaagtttgtgttgtgtgtaaggtattgtgtaaaaggagtatattagttttttattttttagggatggatttaggttttttttagttttattatttaattataggtttatataagtatattttagatgtatttatgaaattatgttgtaaattgatggatgatattaatttatatatagtattgttttaaatttatttaatttttataataattttataaggtaaatgttattattatttttattttagaatataggaaaatgacgtttggagaagttaagtaatttgtttaggttagggataagtggtagagttaggtatttggtttaagattttttattgttaagtattatgttataaataaatagatatgaagttattttgaaaagaggaggattaaggttgagtattttagggtgagggtgtatattagtattttggttgtaggtttacgtttaagagttttaagtatttagtatcgttaatatgttgtaaaggttttagcgaatttatgtaagttagtttaaagttgttatttttataaagagatattgtgatataatggaaagaatatgtaatttgggtttatgtttatatttttttaaggataagtggtttgggattagtgatttttttttttttttttttttttttaaattttttttgaaatagggttttattttgttttaggttggagtatagtggtgtgatttcggtttattgtagttttgattttttaggttgaggtgatttttttattttagtttttcgggtagttggaattatagatgcgcgttattacgtttggttaattttttgtatttttagtagagatggggttttattatgttttttaggttagttttaaatttttgggtttaagtgatttgttaaatttaagatttttaaaatgttgggattataggtatgagttatcgtgttaggtttattttatgttttgatattgaatagatttaggaagatttttttacgataaaaagttcgattattttaaaagaaaatgatttattgatattagtttttttgagttttaggcgttagtaaatattgagtgaaagaaaaagttttttatagagtttagattgaaaagagaaattaaatgatt

SEQ ID NO: 261 - DNA, 4398 bp, Artificial Sequence
  chemically treated genomic DNA (Homo sapiens)
aattatttaatttttttttttaatttaaattttatgaaaggtttttttttttatttaatatttgttagcgtttgggatttaagaaggttaatgttaatggattatttttttttgaggtagtcgaattttttgtcgtagaaaaatttttttgaatttatttagtattaaaatatggggtgggtttggtacggtggtttatgtttgtaattttagtattttgggagttttgagtttggtagattatttgagtttaggagtttgagattagtttgggaaatatggtgaaattttatttttattaaaaatataaaaaattagttaggcgtggtggcgcgtatttgtggttttagttattcgggagattgaggtaggagaattattttagtttgggaagttaaggttgtaatgagtcgagattatattattgtattttagtttgggatagagtgagattttgttttaaaaagaatttaaaaaaaaaaaaaaaaaaaaggaaattattagttttaaattatttatttttggagaaatatggatataaatttaaattgtatgttttttttattatattatagtgtttttttgtaaaagtggtaattttgggttggtttatatgaattcgttgaaatttttataatatattggcggtgttgaatatttggggtttttgaacgtaagtttgtaattaggatgttggtgtatatttttattttggaatgtttagttttgatttttttttttttagaatggttttatatttatttatttgtaatatagtgtttaatagtaggaagttttgagttaaatgtttagttttgttatttatttttgatttgagtaagttatttagtttttttaggcgttatttttttgtattttaaaatggagatgataatagtatttattttataggattgttgtgaagattaaatgagtttagggtaatgttatatataggttagtattatttattaatttgtaatatgattttataagtgtatttagaatatgtttgtgtaaatttatggttagatgatgaagttaagaaaagtttgagtttatttttggagagtaagaaattagtatattttttttatatagtattttgtatatagtataggtttaatagatatatttaaattgaattgaagcgaatattattagaattgaaagtggtagttttagattttttaggtttaaggtttagattttataagtgtttttgattattttttttttattttatttatcgtaaagagtagaggttaggaaaaggatgaataattaatgattttaaaatttaggtgagaataaaaattagttttgagaaatcgtgtgatatttatattttggtatttgagttttagattattttgtatgtgtattttttttgtataaagtttaggaggttatttttatattattggggtaaattttttaatagttttgggtattaaatagtttttagtaggtgtttttaaatttttttatttgttttaatttttaggttgttaggggaagtttggtcgataagtttatatttttgggtagattgagtaatagtaggtggtggtttttggataagaggtgttttaggtcggaaggaaataaatgagattacgattagttaaagttcggtaaagtaagagacgtttttaattcgacgattagacggtggtttcgtagtatagattttttcggatggtggaatttttaatcggtttcgatgtagtttcgtttttatttagattacgtttattaattatcgtttttttttttttaggtttcgtttggagttcgttttttttaaagtatgttttatttgatttcgatattgtcgggtttagttcgtcgggtttagttcgtggagcgtttgcgtattttttgagttgtcgtggtattgtttaaatttgaatgggggaaagagggaattttatattttttatagatttcgttatagcgattttgcgtgtttttttagagttggttttgtttttcgtggttttgagaattttggtttttggttttttaatgcggtttaagtgtgtaggttttaagttaggcgattttcgggtagttttagttttagtatcgggtttttgcgttgagtttcgggattatagtcggggaggcggggtttttttttggggcggtcgcgttggtagcggatgcgggaagtcggattttgggcgttatgtattataagtttagtggttttacgtagaagttggtaggagtatgggtttcggaggtttatagttcgtaggtacgagtggcgtttggttagttcggatatgagaagtggcggttttagtttcggcgataggtagtcgcggcgttggagttaggggaggtttttgttcgcggtcgagttcgtttttgttttttttgtatttttcggggtttttttatattagcgtacggtggttattgaggtttttttttgtgtatttgtttatttggcgggggttggtttggcgtggaagtttggtttggtttattgtaggggttaaggtgattttcggggttatttgtttaaaagggatggtttgtgggggtttttagtgtgattcgagttagaggttcggtttttttttttaattcgaagatatttggttttcggtttttttgtcgtttgttatttgttagagttttataggtagttttatttgagttcgagattagagagcgcggggttataaaggcgtttagagaaattatggtgtagggggttggggggttatgatttgggttgggaaatttaataggttatttaatacgtttagggagggaagttgtatgtagcgaggttatattttttcgattgtaaaatatttgatagatgttcgttgtttgggttgtttgaaaagtattttattttacgtagattttattaattggagtttgattttttagtatgtgttgggggtaaatatgagggattttagagttttagacgtgtttttttaaattatggcgtttttcgttttaattgtgtgattttggttaagttatttaatttattgtgagtttagttttatttagggcggcgttagtatatattaaatgaagtgtgttaagtgattagtagtttgggtaggtggttggttttggataagtgttaattgtttattagaagttgtttgagatagtatatttttttttaattttttagagaagtgtgggaagtgtcggtgagatacgtagttagattgtagtagtgaggggtttagatgaggtgtaaaggatattttattattgttgttttattttttttttttgtgggatattgtagtttgtttaagaggtagatgtttaagaaagattttaggtttggtatcgtggtttacgtttgtaaattatagtattttggaaggtcgaggtcgagggtcgtttgagtttaggagtttgagattagtttggggtaatatagtgagattttgtttttaaaaataaaaatagatgattttaattttagataagaagggtaagttttttttttttttttcgggggttagtgggggagttgcggtgggaacgggaaggaagagtttagggtttataaatgttgagtttgtgatatgttatgtttggtagtagttagatttttgaatatggagtttaataaatttgggtgtttttagtttataggtggtaatttgtagggaagaaaggttggattatagttagagtatagaaatatgagggaagggtggagaaggagaatgtgtttaaagaatagttcggatgagaagggaaattagtgtggttttattgaaatcgaattggtaatgatttgtaaggaaggaatagttagtagtgttgtattttttttatagattatgtgagaaaatggttatttttattatttgtttttatgaaatgtattttttagtgtatggatattaaatgttatagtttgatgagtttggataaatttatgtattgtataattatattttttttaatatgtaagatgttatattattttaggaagtttttttgtattttttgttaatttttgttatttttttattttgatttttattattataaatagatagttttgtttttttttgaattttatgtaaatggaattagttttgatttaggttggagtgtaatggtatagttatagtttattgtagatttatttttgagtttaagtaatcgttttgtttttgtttttgaaaatgttggaattatagatgtgagtcgtcgtgtttggttgtttaaaaaatatttttgaggttagttcgtgttgtacgtattagtagttaattttttttatttttttatttttttgtgggattttattttataaatatattatagtttattttgttggtggtagtagatgtttttttatttatttttttaaaatattttttgagatag

SEQ ID NO: 262 - DNA, 4471 bp, Artificial Sequence
  chemically treated genomic DNA (Homo sapiens)
aatttatagaggtatatttatagaggttaaattttattgtatgtaaattatattgttgtagtttaatttttttaaagtgttattgtatataaaataatgtgttagatattgaattatgaaatttaacgtttaagtatataatttttaaggtttttagatgtattattaaaaatttattattaaatattttgagtttagtttttagtattttatattttatttatatttatattttataaaacgatttaaagtattatttaaaattattatatgaattttgaattattatgtgtttaatatatatttatagaaaattttttttttatttttaaaagtgaatatattaatatttattaaatgttaattatatggttatgagttgaatttattattaaattttattttttttgaattataaatatattaagaaatgtaaattgtgattagatttatttatattttttagaatattacgaaatgtgttttaaatatgttaattgattttagaaatttttatgttttgagtaagatttaagtgttaataagtatttgatggtttttaaaataagaatgttttagaaatttatttaaaaaaatgtttgaacgtaaaatgtaattttacggtgtatattttaatgtttgttgatgaatagatttttatagttttttttttttagaatttatattaaaatatattttttttagaaaaaataggagttaaagatgttaattatgttttttttatagttacgttatatttgttttataatatttttagaaaagtttttttttttatatgtttattttttaaattataaatatgtttttttttattagatatcgagttacgaaatttagagtaaaagtaaaattttttaatggaatgtttatgtaaatattagaaatataataaaataaggtaaagtttgttttttaaaatgttgtttattatattaaaatataattttgttttttaaatagcgagtaaaattaaattaattttatttttttaaatagaagtttatttaaagtttttttataaaaatgatatttatttgatttaatattgtttttttaataagaataatacgtagggtgttagagggtagttgttggatttttttttagtaaataaaggagattagttagagtttagtttggtttgtttaggaaaggaggaacgtagtttgttgatatggttaaggaatgttaattaatatattttaaaatttttattattttgtttgagacgtgtatatttttttaggtttttaaagtttaattagaaagtgtatttaattttattgttattttatttatagtggggaagtttatcgaggaaaattatagggaaataaaatgttttttagttatttatattagtataattaatttagagtttacggtataaattaaataagttaatttgttagtgttttgaatgaagatatttaattaaagtatgtattttttaattttttagtagtttttaggatagttggttttggtgatcgttttttggttttttattgtttttaatacgattggttttttatcgtaggattttaaataaaatgagataattaaattatatttcgagcgaaggggcgtttattttgtagataaatatatcggttttgttttttttaaaatgcggatacgtgtttttttcgtattagggggggtttttcggcgcgcgtttcgtcgttatttgttgaggaaagcgagcgtattttttgtagtttaggtttcgggcgttagttttgtttcgtagttttagagttcgtcgtagttcgggtggttttttttcggtttagcgttcgtcgtttgtttttcgttttgtaagttttaagaggtagttatttttcgtagttttcgcgtttgtaattgttttttggcgggggagtgggtgtttaaaaagttagtagttggagaaattgaaaagattataagcgatttaacgataagtttttttttttttttaaagatcgagaggagggtagaggggagtagtgtttgagtttacgtgatcgagttagggagttcgacggttttaggaacgttcgacgtcgcgcgtgatttttaagtgggagtattttcgaatcgatttttggtttatttataaggatagtggcgtatagatggcgtttttcgtagttttagttttagatttaagaggtttggagtagggtttgagaatatgtatttttaattaggttttgggggatgtcgatattgatatagttagtttggggattatatttcgaggattacgtttttagtttttgatttatataagtgttatttagaatagatgtttgattttaaggagttagtggtgaaattagagaggttttgggtttgttaaatttttagtagtaaacgtaatttcgggttttggagtggtaaagtcgtggattagaggtggagggagtgggtttttagtttttaagaggttattgggaaggtttttcgcgttagattaaagattttaggtattttttcgaatttatttgaagtggtatcggggagatttgtgttttcggttacggcgttttttttcgttggaggtatttgtttattttttttttcgggcgaaggtttttcgcgttttttggtggtagttttagtttttttagtttaatggggtgttttttttatttattttagtaggagttttagggtgcgagattaggattatagttttaattggttttaaggtagttgttgttgatgaaaatgaaaaggaaagtagtatgtgatttataggttattgtgagaattttttagtgttatatttgtgtttaattaattattaaattatttatttaggtggtataagggatatggtttttgagggttgtgatttagatttttaatagaggaagacgagggggggtatttggagggaaagttttatagtattagttttagttgtttggtgtttagttaaaatagagagacgtaagtgtgttttgggttgataaagatgaggtttataggtaatgaagataggttttaaagatggagaagtatttgttttattagttaaataatagttgtgaaaagtttttattgttttattttaagtttaatttttattaaagttgagagttttggttttttttaggttgaaaggtagagtttttttgtttttgaggtagagaagttagtttggacgggaagagtgtgtcgttggtaaataattgtagtagataatatgttaattttagtttttttgttttttgttttggggttttttaaagtatttagtttttatatgttttttttttttgttattttatggagaaaatgttaaatgatggtttaaaaaaattagttttatggttaggtatggtggtttatatttataattttagtattttgggaggtcgaggtaggtggattacgaggttaggagtttgagattagtttgattaatatggtgaaatttcgtttttattaaaaatataaaaattggttggacgtggtggtatatgttagtaattttagttatttaggaggttgaggtaggagaatcgtttgaatatgggaggcggaggttgtagtgagttaagatcgcgttattgtattttagtttgggcgatagagcgagattttgttttaaaaaaaaaaaaaaaaaaaaaaattagttttatttggtggtatatatttgttaataagatatttttggaaatggaaatcgttatgaaggaattttaattataagttaataggtagaaaaagataggtgagggtgaagaaaatgtatttattaatattaatattatatttgacgttgtgttaagtatttgtatagtattttatttaatttttatattagtttagtgagatattgattttatttttttagtgaggaaattgaggtttatagagtttttgttagttatttgaagttatttagtgagaaaggaatttagtaataatagtggttttatagatagttatcgtttattggatatttatgtttcgtttttttttaataatttttattttatacgtaagtttataaggtaaattttattatttttattttatatttgagaaaatgaatgtttaggaaggttaaataatttttttatggttatatgatttattagtggttaagaaggatttgaatttaggagagaggttaaggatttatttatttttatattatgtttttaattaattagaatgaaaatggtttgattttttgttttatgtagaatattgtagataaatttttgttatttgtgtgttaagtttttgttttgtgtttattgtgatgttttttttagaaggtattttatatataggaatagtatgttttttttttagagtagtttaaatatttatagaagttgtttattatataaggaaattttattgtaggaaataataagtagaaaatgaatgggagtgagtaagtttttttttgatttattttgtttattaagaaagataatgg

SEQ ID NO: 263 - DNA, 4471 bp, Artificial Sequence
  chemically treated genomic DNA (Homo sapiens)
ttattgttttttttgatggatagggtgagttagaaggaaatttatttatttttatttattttttgtttattattttttgtagtgaggtttttttgtataataaatagtttttgtgggtgtttgagttgttttgaaaagagaatatgttgtttttgtgtgtagaatgttttttgaaggaagtattatagtgaatatagagtagaagtttggtatataggtggtagaagtttgtttgtagtgttttgtatagagtagagagttaagttatttttattttgattgattggaggtatggtatggaggtaaatgggtttttggttttttttttggatttaagttttttttagttattgataggttatgtgattatagggaggttgtttaatttttttgaatatttatttttttaagtataaaatgggggtaatagaatttgttttataggtttgcgtataaaataagaattattgagagaaagcggggtataaatgtttaataagcggtagttgtttatgaagttattgttgttattgggttttttttttattaggtggttttaggtagttgatagaagttttgtgagttttaatttttttattggaaaagtggagttaatattttattgagttggtgtgaggattaaatgagatgttgtgtaggtgtttagtatagcgttaggtatgatgttaatattgatagatgtattttttttatttttatttatttttttttgtttgttggtttatggttgaaatttttttatgacggtttttatttttagagatattttgttaataagtatatattattaaatgaagttgatttttttttttttttttttttttgagatagagtttcgttttgtcgtttaggttggaatgtagtggcgcgattttggtttattgtaattttcgttttttatgtttaagcgatttttttgttttagttttttgagtagttgggattattggtatgtgttattacgtttagttaatttttgtatttttagtagagacgaggttttattatgttggttaggttggttttaaatttttgatttcgtgatttatttgtttcggttttttaaagtgttgagattataggtgtgagttattatgtttggttatgaagttgatttttttaaattattatttaatattttttttataaggtggtaaggaggaagagtatatggggattgggtattttgagagattttaggataggagatagggaggttgagattggtatgttgtttgttgtagttatttgttagcgatatatttttttcgtttaaattaatttttttgttttaaggatagggagattttgttttttaatttgagagaaattaggatttttagttttaatgaaaattggatttagggtggggtagtggagattttttatagttattgtttagttgatgaagtagatgtttttttatttttggagtttgtttttattatttgtggattttatttttattaatttagagtatatttgcgtttttttattttggttaaatattaaatagttgaggttggtattgtaaaattttttttttaaatgttttttttcgtttttttttattagagatttggattataatttttaaaaattatgttttttatgttatttgagtagatggtttgatgattaattaggtatagatgtgatattggggggtttttataatggtttgtgggttatatgttatttttttttttatttttattagtaatagttgttttaaagttagttaagattgtggttttagtttcgtattttggggtttttgttggggtgggtgaggggaatattttattaagttgggggaattggggttgttattagggggcgcgaggggttttcgttcgagaagaggggtgggtaggtgtttttagcggagaagggcgtcgtggtcggaggtataggttttttcggtgttattttaagtgagttcgaggaagtatttgggatttttgatttaacgcgaaaggtttttttagtgattttttgagagttgagaatttattttttttatttttagtttacggttttgttattttagggttcgaggttacgtttgttgttggggatttgataaatttaaagtttttttggttttattattggttttttagaattagatatttgttttgaatgatatttatgtgagttaggggttgaggacgtgattttcgaagtgtggtttttagattggttgtattagtgtcggtattttttaggatttggttggaaatgtatatttttaggttttattttagattttttaaatttgagattggggttgcggggagcgttatttgtgcgttattatttttgtgggtggattaggagtcggttcgagggtgtttttatttagaggttacgcgcggcgtcgggcgtttttgagatcgtcgggttttttggttcggttacgtgggtttaggtattatttttttttatttttttttcggtttttaaaaggaagaaggggtttatcgttaagtcgtttgtgatttttttagtttttttagttgttggttttttggatatttattttttcgttaggaggtagttgtaagcgcggaggttgcgagaaataattgttttttgaaatttgtagggcgaagagtaggcggcgagcgttgggtcggggagggattattcgagttgcgacgggttttggggttgcggggtagggttggcgttcggagtttgagttgtaggaggtgcgttcgttttttttaataggtggcggcggggcgcgcgtcgggagattttttttaatgcgggaaaagtacgtgttcgtattttagagaaggtaaggtcggtgtgtttatttgtaaggtaagcgttttttcgttcgaggtgtggtttaattgttttattttgtttgaaattttgcggtgagaaattagtcgtgttgagaataataaaagattaaaaaacgattattaaaattaattgttttgaaagttattggaaagttggaaaatgtatgttttgattaaatgtttttatttaagatattggtaagttaatttatttagtttgtgtcgtgagttttgggttgattgtgttaatatgaataattgaaaaatattttatttttttatggtttttttcgatggatttttttattatgggtgaaatgataatggagttgaatatattttttgattgaattttgagggtttgggaagatgtatacgttttaggtaagatgataggggttttaaaatgtattaattggtattttttagttatgttagtaagttgcgtttttttttttttgggtagattaagttaagttttaattggttttttttatttgttgaagaggagtttaataattgttttttaatattttgcgtgttatttttattggaaggataatattaagttaagtgaatgttatttttgtgaaaaaattttgagtggatttttatttaggaagataaggttgatttaattttattcgttgtttaaaaagtaggattgtgttttggtgtggtaggtaatattttggaggatagattttgttttattttgttatatttttagtatttatatgggtattttattagaaagttttatttttgttttaagtttcgtaattcggtgtttagtgaggggaaatatgtttgtaatttaaaaagtgaatatgtgaaaggaaaggtttttttgagagtgttgtaaaataaatgtaacgtgattatgaaaagaatatgattaatatttttgatttttattttttttgaagaaaatgtattttgatatgagttttagaagaaggaaattataaggatttgtttattaataggtattagagtatatatcgtaggattgtattttacgtttaagtatttttttagatgaatttttgaaatatttttattttaaaagttattagatgtttgttaatatttaagttttgtttaagatatagaagtttttgaaattaattaatatgtttaggatatatttcgtagtgttttgagggatgtgaataaatttaattatagtttatattttttaatgtatttataatttagaaaaggtagaatttagtagtaaatttaatttataattatataattaatatttaatagatattgatatgtttatttttaagaataagaaggaaattttttataagtgtatgttgaatatataataatttaaaatttatgtgataattttaggtgatgttttgagtcgttttatagaatataaatatggataaaatataaaatattgaaggttgaatttaaagtgtttaatgataagtttttgataatatatttagaaattttgagaattgtatgtttgaacgttagattttataatttagtgtttagtatattgttttatatgtaatagtattttaaaaaaattaggttatagtagtataatttatatatagtaaaatttagtttttgtaaatgtatttttatgaatt

SEQ ID NO: 264 - DNA, 4479 bp, Artificial Sequence
  chemically treated genomic DNA (Homo sapiens)
cggtggtttacgtttgtaattttagtattttgggaggtcgaggtgggcggattataaggttaggagatcgagattattttggttaatacggtgaaattttatttttattaaaaatataaaaaattagtcgggtgtggtggtaggcgtttgtagttttagttagtcggtaggttgaggtaggagaatggcgtgaattcgggaggcggagtttgtagtgagtcgagattgtgttattgtattttagtttgggtgatagatcgagatttcgttttaaaaaaaaaaaaaaaaaaatatggttgggcgtggtggtttatgtttgtaattttagtattttggaaggatgaggtgggaggattttttgaatttagaagtttagtaaaattttgtttttaaaaaaaaaaaagaattgtgtataaagattttagagagtgttaaagattagcgtatggataaggaagttttgtgaagagttgaagtgttaggtgaagaggtggtacgggggaggagggggcggaaggggagaaagggtgttacgttttataacggtttttaaatttttttgtttaggaggaaatgaagttatttgtttttagtaattagtatgatagtttttagttaagtaatttggagttatgagagttgttaggggagtaatatgaattatgacggtttttgggaattttttgataattaatttgggagtttcggggtaagtttttaggttgtagtatttttgtttatgttttggttacgtttatttataattaatgggtttttaaatttaaataaaattgattatagttttttagaggaagtagtaaggttggttttgaagtttatagtatcgttgatttagtttgttttttggaaggttggtagtttagtaagtatagaagtttttttagaagatagtgggttatttgttttttaaaagttgaaaggttaatttgtattttttttagtaggtagttggtattttgagttttcggttggggtagagtaaaggagttttttttttttttatttttttggtattttttttgttttttttttgttatttttaggtggatttagatttaaggtttagatttgtaaggtaggaaaatgttgtaggtttaggttgggaaagggtttaaagtcgttagtggattgttgggatttagtttttttttttttattaagagagcgagttttattgggtttaaaatgattttaagttttggtttttgatattaggggaaagagatgggggtgatagaattatagaatttttgttatgtttttttaagtgtgtttagagatgcgtgtgtgtgtgtgtgtgtatatataaatgtttgtttatttttaggtaggaagggtggatgtagttatttatatatggtttgtttttttggaggataattttatttgataaataattgtttttatttgaatagaataaataaggttttatgatgaagtaaaatattaaatatatatgtattaaaaaatgtataattatttttttggaatgggttatatagagatgtgttttttaaaatgttaagagtgtaaaaggataaatagtgaaaaataaattttttttttattttgttttttagttttttaatttttttatttagaggtgagaatagaatttttatattttttagaatttttatagttagaattgtttatatgtttttattgtttttatttttatttttgtttgtataaataaatgaattgtttattatggaaattttttaaaagattcgttaatattttaataggaagtattaatagtttatgttttaggattttgtttttataattttgtaatattatattacgatatttaatttaatttttattaagttttgttaaaaacggattttaaattaagttgtaaatttttagtaatttggttttgtttttttttttttgatagtattattaaataaatttttttattgtcgaaagtaataagttcggttttgttttatttattggttgtgttggtgatatttggggattgttattgaatagacgtatagagggagtttttataggtaggggtttttttgtttgtgtttttgggagagtatgtttcgtatatttgtcgcgttgatgaagattttatagttttattagttgcgggtaagggggtttgaggtagttttaggtaagttggggtttagcggggagaagttgtagaagaattgattagaggattttaggaggttttagagttgggcgaggtagagagttttttgtgcgtttttttttttttttgtaattcggggattttttgtattggggtaggttttcggttaggtgtatgggaggaagtacggagaatttataagtttttcgattttttagtttagacgttgttgggtttttttcgttggagatcgcgttttttttaaatttttgtgagcgttgcggaagtacgcggggttcgggtcgttgagcgttgtaagataggggagggagtcgggcgggagagggaggggcggcgtcggggcgggttttgatatagagtaggcgtcgcgggtcgtagtatagtgcggagatcgtagtttcggagttcgggttagggtttatttgttttcgtagcgtcggttcgcgtttttttgtcgtagttatcggtgagtgtcgcggttttgagattttcgggtcggatgcgcggcggttttagttttcgagcgtttgtttttttcgttttgggttgttcgggttttttgggtttttcggcggttgtacggagttaaggcgtttcgtttcgggcgtttttcgcgggtgtcgatttaggttgttcggagttcggagtttagagaggagagagatagttggggagtttggttatcgcgggtattttttttgcgttgtagtcgttcgtttggtttgttttttcgttttttcgttttttgttttgattttttttttttttgtagagtcgtcgtttagcgtttcgatttcgttattatgagagttttgttggcgcgtttgtttttttgcgttttggtcgtgagcgattttaaagtgagtgcgtttttgttttgattgatgttgtttaaggatttttgattagtattaggggagaggaggggttgtttagggagttggggtttttcggattttatttatagtagggttagattttttttaggaaatgggatagggtggtagcggaggtttgagaattacgggggttggtattggttggtaagggaggaagaggtcgtcgggattgttttagtttgcgggtatttggtagatgaagtttgtttgggttaatttattttttttggttggaaatttatggttttttatttgagaattagatacgaatagggtgaggcgagagggagagggaagagtgggttttgggattggggttagtttatttttattttggagtttttggagtatgggatttttgatgaagttttttttcgaattttttttagggtagtaatgaattttattaagttttatgtgagtatttatttttataatagttggttgtatagataagttgggaaggttttaggggatattttttttttgttttttgttgtagggttgcgttattttttattatttttattttttttcgtttattttatttttgttttttttagcgaattgtgattgtttaaatggaggaatatgtgtgtttaataagtatttttttaatatttattggtgtaattgtttaaagaaattcggagggtagtattgtgaaataggtatggggatttttattgtaattgggagagaaatttggggatagggagggatgggtgggaggtaagagtaggtaggagttaggagttggaggtagggtgggtgatatttttatttttatgtgataagtataaatatatatatacgtttacgaaatagtggttatataaatgtgaggtggggttggaaggagattttgtttagttttttggtaggtttgaaacgatatttttaaaatgttcgttggtagtcgggtatggtggtttacgtttgtaattttagtattttgagaggttaaggtgagtggattatttgaggttaggagtttaagattagtttggataatatggtgtaattttgtttttattaaaaatgtaaaaattagtttggtatggtagtggatgtttgtagttttagttatttgggaggttgaggtaggagaattgtttgaatttgggaggtagagattttagtgagttgagattatattattgtattttaattgggcgatagagtaagattttattttaaaaaaaaaaaataaaagttagttggaatgttttttttttttttatatttttttatttttttgtttttttgtagataagttaaaaatttgttatgaggggaatggttatttttatcgaggaaaggttagtattgatattatgggtcggttttgtttgttttggaattttgttattgttttttagtaaacgtattatgtttatagatttgatgttt

SEQ ID NO: 265 - DNA, 4479 bp, Artificial Sequence
  chemically treated genomic DNA (Homo sapiens)
gagtattagatttgtgggtatggtacgtttgttgaaggatagtggtagagttttagggtaggtagggtcggtttatggtgttagtgttggttttttttcggtaaaagtgattattttttttatagtaggtttttgatttatttataaggggataggaggatgagagaatatgagaaagagaagaatattttaattaatttttattttttttttttgagatggagttttgttttgtcgtttagttggagtgtagtggtgtgattttagtttattgagatttttgttttttaggtttaagtaatttttttgttttagttttttaagtagttgggattataggtatttattattatgttaggttgatttttgtatttttagtagaggtagggttatattatgttgtttaggttggttttgaatttttgattttaaatgatttatttattttgattttttaaaatgttgggattataagcgtgagttattatgttcggttgttaacggatattttaaagatgtcgttttagatttgttagaagattggatagggtttttttttaattttattttatatttgtgtggttattgtttcgtgagcgtgtgtgtgtgtttatgtttgttatatagggatgaagatgttatttattttatttttagtttttaatttttgtttgtttttgttttttatttatttttttttgtttttaaattttttttttagttgtagtggagatttttatatttattttatagtgttgtttttcgaatttttttgggtagttgtattagtgaatgttggagaagtatttgttggatatatatgtttttttatttagatagttatagttcgttggagagaataaaggtggggtaagcgagggggagtggaagtggtaaggggtggcgtagttttgtagtagagggtagggaggggatgttttttgaagtttttttaatttgtttgtgtagttaattgttgtaggggtggatatttatatggaatttgatgaagtttattgttgttttggaagagattcgggaggaggttttattaaaggttttatgttttagggattttagggtgagggtaaattggttttaattttaaaatttatttttttttttttttttcgttttattttgttcgtatttagtttttaaatggaagattatgggtttttagttaggagaaatggattgatttaagtaagttttatttattagatgttcgtaggttggggtagtttcggcggttttttttttttttgttagttagtgttaattttcgtggtttttaagttttcgttgttattttgttttattttttggggagagtttggttttgttgtggatggaattcggaggattttagttttttgagtagtttttttttttttttggtgttgattagaggtttttgggtagtattagttaaagtaagagcgtatttattttggagtcgtttacgattaggacgtagagaagtaggcgcgttagtagggtttttatggtggcgaggtcggggcgttagacggcggttttgtaaaggaaggagaagttagggtaagaggcggaggaacgggaaggtaggttaggcgggcgattgtagcgtaggggagatgttcgcggtgattaggttttttagttgttttttttttttttgggtttcggatttcgggtagtttggatcggtattcgcgggggacgttcgggacggggcgttttgatttcgtgtagtcgtcggggagtttagggagttcgggtagtttagggcgggggaggtagacgttcgggagttggggtcgtcgcgtattcggttcggggattttaggatcgcggtatttatcggtggttgcggtaggagggcgcgagtcggcgttgcggggataggtggattttggttcgggtttcggggttgcggttttcgtattgtgttgcgattcgcggcgtttgttttatattagggttcgtttcggcgtcgtttttttttttttcgttcggtttttttttttgttttgtagcgtttagcgattcggatttcgcgtgttttcgtaacgtttataaagatttgggggaagcgcgatttttagcggaggggatttaatagcgtttggattgaggaatcgagaggtttgtaaatttttcgtgtttttttttatgtatttggtcgggggtttgttttagtgtaaggagttttcgaattgtagagaggagagaaggcgtataggagattttttatttcgtttagttttgaagttttttggggttttttaattagtttttttgtaattttttttcgttgggttttaatttgtttaagattgttttagatttttttgttcgtagttgatggagttgtgaagtttttattaacgcgataaatgtacgagatatatttttttagaagtatagatagaaaaatttttgtttgtaggggttttttttgtgcgtttgtttagtggtagtttttagatattattaatataattagtggatggaataaagtcgggtttattgttttcggtagtaagggggtttgtttgatggtgttattagagggggaaaggtaaggttagattattgaaaatttgtagtttggtttaaagttcgtttttgatagggtttgataaggattgggttaggtgtcgtgatatgatgttataggattgtgggaataaagttttagggtataaattgttggtgttttttattgaagtgttaacgggttttttgggaagtttttataatgagtaatttatttatttgtgtaggtaagaataaaagtaaagataatggaaatatgtagatagttttaattgtggaggttttggagggtgtggaagttttgtttttatttttgagtagaggaattgggagattggaggataaaataagaggaagatttattttttattgtttgtttttttatatttttaatattttaaaaagtatatttttgtatagtttattttaaaaagataattatgtattttttaatgtatgtgtatttagtgttttattttattatagagttttgtttattttatttagatagaaataattgtttattaaataaaattgttttttagaaaaatagattatgtgtaaatgattgtatttattttttttgtttgaggataagtagatatttgtgtatatatatatatatatatacgtatttttgggtatatttggaggaatatagtagggattttgtgattttgttatttttattttttttttttagtgttaggaattagggtttggggttattttgaatttagtaggattcgtttttttagtgggaaggaggaggttgagttttagtaatttattagcggttttgggtttttttttagtttaggtttgtagtatttttttgttttgtaaatttggattttgggtttgggtttatttgagagtgatagaaggaaggtagggagagtgttaggaaggtaggaaggaggaaggtttttttgttttgttttagtcgagggtttagggtgttagttgtttgttggggaaagtataagttagttttttagtttttgggaggtaggtgatttattgttttttggagagatttttgtgtttgttgagttgttagttttttaggggatagattgagttagcgatgttataggttttagagttaattttgttattttttttagaagattgtggttagttttgtttggatttgagaatttattaattgtaaataaacgtgattagaatataaatagagatgttgtagtttgaggatttatttcgaaatttttaggttagttattaggaaatttttagggatcgttatgatttatgttgtttttttagtagtttttatgattttagattatttggttggaggttgttatgttgattgttgagagtagatgattttatttttttttggataaagaggtttggagatcgttatgaagcgtgatatttttttttttttttcgtttttttttttttcgtgttatttttttatttagtattttaattttttatagaatttttttatttatgcgttaatttttagtattttttgaaatttttgtgtatagtttttttttttttttaaagataaggttttgttgggtttttgggtttaaggggtttttttattttatttttttaaagtgttgggattataggtatgagttattacgtttagttatatttttttttttttttttttgagacggagtttcggtttgttatttaggttggagtgtagtggtataatttcggtttattgtaagtttcgtttttcgggtttacgttatttttttgttttagtttatcgattagttgggattataggcgtttgttattatattcggttaattttttgtatttttagtagagatggggttttatcgtgttagttaggatggtttcgattttttgattttgtgattcgtttatttcggttttttaaagtgttgggattataggcgtgagttatcg

SEQ ID NO: 266 - DNA, 4492 bp, Artificial Sequence
  chemically treated genomic DNA (Homo sapiens)
ttgtaggttgcgtttagtttttgtgtattagggatagtaaggaaaatttaagttagattagttttaggggtggtagcggtttttatttttagagaagaagaagatattttggatgggtttataggtggtaggtataagttagtttattttgtagttattatagttgttggtttttaagttgttttttttattggagaataaggatagttacgtggcgcgggatggtcggcgggagttttggttgcggttacggttgtggtttcgttgtgaacggtagtttttgcggttgcgatgtttaaatttttgttttttggttaaggaggggcggggtgttatgtttgagatgtagatgcggttagttatggttgcgtttatttgttttggtatatcgtgttagtttcggttaatgaattggggttgtttggtattagttgtggtagggaaggggtgaatgagaggttttgggggttcgaattttgttttttttagcggggttattagagtttatttgttgtattttgtttaaagatatatagtagcgaatggtagagttaggtttttgatttttagtttaatttttttttttttgtgttttttttttattatattattggtgtttcgattttatttttttaggttttttaaattttttagttatagtttttttttttgttggttgtgtttttagttgtgttaggtaaagtttaaggtgtggggtttaggtagagttgagttttttttaaaaggttaatagaagtaaagtttggtttgagtaaatagattttgatcgatagttttataattatagttttttttagtcggtttggttttattaatattaaggggttttagtttttttgagggagaagtaagatttgttttttttttatattagaggttttgttttagaagagaagttcgaagatgtttttttagttgtttcgttgtattatggtaaagtgtttaaatatagtcgatagggagttgtttttatattttttttgattgggttggtgttggaattggtatttttagtattgtttttttgaggagtagggtggtgggtattaggagggttgggttagggtaagattggagattttagaggttgttgaagttaggattttttagtatgaggtgggggttaggggtgggtatatgttgaggtttgtttttagtgaaatgtgaaaggaatttaagattgttttattgtttgtttagttttttattattttttgagtatttttgaagaagtagattcgttttcggttattgtagttatgggtagggagggttaaggttgtatttacgttgttcgggatgttatcgaagtcgttagagatatttcgggggtaattagggtttaggatattatttttaaagcgttagtattgattattttaagaggtggggaaagtgaaaaggggtatggaggtcgttggttgggtatagaggtagagttttttgttttaaggtagtcgtttttaggtttaggtttattgtttaggatttggagttttggggttgttttgtgtttatagagtttttattaggttttgtagggttttgggtttagtttttttgtttattttgtttttgggagtaatagtttttaaattttttttagatgttttttattttggtttatagtttttggtattttgaagaggtaggtttttttttgatagttgatgcgggtgaaggcggtatcgatggggttttcgatgttttagatatttcggatgagtttggggtatttaggttttattgttttttcgtttagtttatagtagtattgttttagagtggaggagatggtgtgagagtagggacgtttttggggtagattcgtatttttagtatttgttttggatttatttcggaaggtaaagagggaatcgtttttgaggtcggtgaaggcgtcgaagggttttttattgtatagttttttttttgttgggggttgaggtttttttggatgaagggttttaggttttgagtttatttttttaggtttagaggcgtttattttaggcgtaggggttttttttttaggttttagaataggtgtttgtttaggattttttttggattgggtttggaggttagaggttagggaggggttttttatttgtttatggatagtggtattgttttttttttcgttatcgttatagatcgtgtatttatttttcggtatagtgaatatattttcgcgagttattgtagagagtggatggtagtgagtttttagtagtagggggtattttagtttatttatttgggttttgaatatattttggggtttgtatttagtcgtatagtttgtgtagtagttttggtagtaagagtagagttcgttatattggtattttttgtttacgttgaagtttttagtgtagcggtttttgtatgattttatgaggaaggagtgttagtcggtgttattaagtttagattattttcgttttttttatattgatttagatggttattaatatttttttgtattttggttagttagagtaatttatgttagtagggttagtatgagaaggggttttaggggtgttatggtagggtttttagtttagtgtttggtaagttgggttttggtttttttgaagttttcgttttgatgtttgaggaagggagggagaggtagagatagggaaggagggtattggagaagaggaattgttttttttgttgttttgtttgtttaatttttagtttattttttttgttttttttagcggttgttgtagtaaaggttatatttttggaatattgggtttgggcgagttgggagataagatttttgttaagtttagaattattaggttatcggaaggggaattagtatcgtggatttggagggtagaaagaaggtttattgggtaatagttttatttttttgagttttagtttatttttagtaaaataggattaataaagttttgttttatggggtgttgggagattatatgaattggattagataaaatgtttagtagttggagtagttataaattttttttttaaatatagttattgatttatgattgtttgattagatatatttttggttgggtgtttattcgttattatttatttagggtaggaaaaagggagtgggaggagagattgtaagtattttggggaattttattttttagtataaaagaataaagttttatttttgggttttttttttgggtgtattaatttttttaggttggaaatttgggtaaatattaatttattggattggatttaatttttgagttttttttgagtaggttattttttgtttttaggtttagtttttttatttgtaaagagtgggtttgtttaatatatttttagattttcgagagaaatatgatttttttatttggaaaatgtttattggtatgaaatatttgattttgtgtttaattttaggtgtttatagaatttttgaaatttttttattatttgaaaaaagtgattttgagattttagttgattttttttgttttgtaattagaggggattgtgatttgggttaattttttttttatgggttttagtggagttagttgtggaatggaatattaatttttattttataggtatgttgtgaggtttcgttaagaaatagttataaaagggttttaagagttatgatgattgttttaattatttagtagggagggggtatttagcggtgttgtttttacgtatcgatgttacgtggggcggggaggcggggcggagaacggagagcgtttttttattttttattttttttttttaagtttagcgtagggggaggtggttgcgattgattgaggggttagggaaggttggttaggggcgtgggcgtggttggggacggtttgggggtggggttgcgtaggaggttggaggagtttcgcgggatttagaggcggggcgtcggttcggggattattgttttttcggggcgtggttgtaggaggttggaggagtttcgcgggatttagaggcggggcgtcggtcggggatcgttgttttttcggggcgtggttgttgtcgagtattttttagtttagtcgagttcgtgtttaggttacgttttgttttagtcgtcgttttttttattttacggcgttcggagttatttttcgtttgttcgtttttttttttcgtttattttttgtatttgggtttgtattatttttgttaatcgttttttcgattttgtcgatattttttttttaaatttttgatcggtatttttgtttggtatttttttttttatttttttttttttatttttttttttcgatttttttcgggtttttttttttttaaaattcgggttttttcgcgtggtttcgtttttaggtcggggatgtttttcgcggtttcgcgtttatggttttgacgttgttttttttcgtttataagttgtgtcgttttttcgttatgtcgggtttacggcggggcgtcgagcggttggcgg

SEQ ID NO: 267 - DNA, 4492 bp, Artificial Sequence
  chemically treated genomic DNA (Homo sapiens)
tcgttagtcgttcggcgtttcgtcgtgggttcgatatggcgaagaagcgatatagtttgtaggcggagagaagtagcgttaggattatgggcgcggggtcgcgggggatattttcggtttggaggcggggttacgcggagagattcgggttttgggaaaagagggattcgagaggggtcggggaaagaagatggagggggaggaatggagagaagggtattaggtaagggtgtcggttagaagtttgggggaggagtgtcggtaggatcgggggagcggttggtaaaggtgatgtaggtttagatgtagggagtgggcgaaaggagagagcgagtaggcgagggatggtttcggacgtcgtagggtagaggaggcggcggttggaataaagcgtggtttgggtacgggttcggttgagttgggagatgttcggtagtagttacgtttcggaggagtagcggttttcggtcgacgtttcgtttttgggtttcgcggggtttttttagttttttgtagttacgtttcggaggagtagtggttttcgggtcgacgtttcgtttttgggtttcgcggggtttttttagttttttgcgtagttttatttttaagtcgtttttagttacgtttacgtttttggttagttttttttagttttttagttagtcgtagttatttttttttgcgttggatttggaggaagggggtggagaatgagaggacgtttttcgtttttcgtttcgttttttcgttttacgtgatatcggtacgtgggagtaatatcgttggatgttttttttttattaaatggttaaaataattattataatttttaaggtttttttatggttgttttttagcgaaattttataatatgtttatggggtgggaattgatgttttattttatagttgattttattgaagtttatgaggaagaaattggtttaaattatagttttttttgattatagaatagaaaaagttagttaaaattttaggattattttttttaggtgatgggaggattttagaagttttgtggatatttgaaattgggtataaaattaggtgttttatgttagtgggtattttttaggtagagggattatatttttttcgagagtttaaaagtgtgttgaataagtttattttttatagatggggagattgagtttggggatagggagtggtttgtttagaaaagatttagaaattaaatttagtttagtgggttgatatttatttaaatttttagtttggggagattgatgtatttaagagaagaatttagaaatgaaattttgtttttttatgttaaaaaataaaattttttagagtgtttataatttttttttttatttttttttttttgttttaaataaataatggcgaatgagtatttagttagggatgtgtttgattaaataattatggattaatagttatgtttggagaaggaatttgtggttgttttagttattgggtattttgtttggtttagtttatgtaattttttaatattttatgaagtaaggttttgttaattttattttattgaaaatgaattaagatttagagagataaagttgttgtttaatgagttttttttttgttttttagatttacggtgttaatttttttttcgatgatttaatgattttgagtttggtaaaggttttattttttagttcgtttaggtttagtgttttaggaatgtgatttttgttgtagtagtcgttggagggggtagaggggatgggttggaggttgagtaaatagagtagtagaaaaggtagttttttttttttagtgttttttttttttgtttttgttttttttttttttttttaggtattagagcggagattttagggagattagagtttagtttgttaggtattgagttagaagttttgttatggtatttttgagatttttttttatattggttttgttggtatgggttgttttggttgattaaggtataggggagtgttggtggttatttgggttaatgtagggagggcgagggtggtttgggtttggtggtatcgattgatattttttttttatagagttatgtaagggtcgttgtattgagggttttaacgtggataagaagtgttagtgtgacgagttttgtttttattattagagttgttgtatagattatacggttgagtgtaagttttaaggtgtgtttagagtttaggtgggtgggttggggtgttttttgttgttggagatttattattatttattttttgtagtgattcgcggggatgtgtttattatgtcggaggatgagtatacggtttatgacgatggcgaggagaaaaataatgttattgtttatgaataggtggggggtttttttttgatttttgatttttaggtttagtttaaagggaattttgagtagatatttgttttgaaatttgaggaagaggtttttgcgtttgaggtgggcgtttttaagtttgaggggatagatttaaggtttgagattttttatttagggagattttagtttttagtagaggaggagttgtgtagtgggaagtttttcgacgtttttatcgattttaagaacggttttttttttgtttttcgaggtgaatttagggtaggtattggggatgcgggtttgttttaggagcgtttttgtttttatattattttttttattttagggtagtattgttatgaattggacgaaaaggtagtgaggtttgggtattttaagtttattcgagatgtttggggtatcgagggttttatcgatgtcgtttttattcgtattaattgttaggggaagatttatttttttaaggtgttaggggttgtgggttagggtagaaagtatttagggagggtttgagagttattgtttttagggatagggtggatagggaagttggatttagggttttgtaggatttggtgggagttttgtgagtatagggtagttttaagattttaggttttgggtagtgaatttggatttgggaacggttgttttagggtaagggattttgtttttgtgtttagttagcggtttttatatttttttttattttttttattttttagggtagttagtattggcgttttgaggatggtgttttggattttgattattttcgaaatatttttgacggtttcgatggtatttcggataacgtggatgtagttttggttttttttgtttatagttatagtggtcgggagcgggtttatttttttaagggtatttagggggtggtgggagattgagtaggtagtggagtagttttggattttttttatattttattggggataggttttagtatgtgtttatttttgatttttattttatgttgggagattttaattttaatagtttttgggatttttagttttgttttggtttagtttttttaatgtttattattttgttttttagggaaatagtattgggagtattagttttagtattagtttagttaggaggagtgtgaaggtagttttttgtcggttgtgtttgaatattttgttatgatgtagcgggatagttgggaggatattttcgagttttttttttggggtagaatttttggtatggagagagggtaagttttgttttttttttaaaagggttgaaattttttggtattggtagagttaggtcggttggagggggttgtggttgtggagttatcgattaaagtttgtttgtttaggttagattttgtttttgttgattttttggggaaagtttagttttatttggattttatattttggattttgtttagtatagttgagagtatagttagtagagggaggggttgtggttgaggagtttagggggtttgggggggtggggtcgagatattagtgatatggtggagggaaagtatagggggaagggaattggattgagagttaaaggtttggttttgttattcgttgttgtgtgtttttgggtaaggtgtagtagatgaattttaatggtttcgttggaaggggtaagattcggatttttaagattttttatttattttttttttgttatagttggtattagatagttttagtttattagtcgggattggtacggtgtgttagggtaagtggacgtagttatggttggtcgtatttatattttaggtatggtatttcgtttttttttggttaagaaataaaggtttaggtatcgtaatcgtaaaggttatcgtttataacgaggttatagtcgtggtcgtaattagaattttcgtcggttatttcgcgttacgtggttgtttttgttttttagtgaggagagtaatttgggagttaataattatgatgattataggatggattggtttgtgtttgttatttgtgaatttatttagagtgttttttttttttttggaggtaggagtcgttgttatttttgaagttggtttagtttgggttttttttgttgtttttggtgtataagggttgaacgtagtttgtaa

SEQ ID NO: 268 - DNA, 4448 bp, Artificial Sequence
  chemically treated genomic DNA (Homo sapiens)
ttagtattttaggagttgatgagtttttatttgggtattatttttttttgggtttgagaaggtcggggggaatttgtaaggaatatgtggaattttatatggtgtttttgatattgcggtaatgttagggagaggtttgtttaattggttagggttttgaaatttcgattatttttttatttttgtattttgaaggttagtagagaggaggaattttgagttttttaggaggtgggtaggtggtggtagtatagatttttagatgtttaaacggagttgtagagagaaggttttttcggtagattttggaagggatttttacggtagaatttttattttataagtagggatagaggtttagatggggatagagacgtgtttaaggtaaaataatggacggaggtagggtagggagaggttaggttttagattcggttttagtattttttttatatatatatcgatatagaagttggtttagatttataatttaatggttgtgtagattttagttttttatttttgtcgtttacgtgtttattggtttggggttagggttttttgtttaaaggtatggatgtgcgggagtttttttgttaggtacgcgtttattagtttggggcgagagatggggttaggaaaaggttagcggtgatcgtatatttcgaggttagggtgatttaagagattggtgtttttaaggttgtagtttttaggtcgtgggaatacgtatttggagagagggtttatatcgaaatattcgaagtaggggttacgaaggcgggatttttaaggtttttgagttacgttagggggagtgcgggagttaggttgtaggggtagggggagtggttggggttgtggtataggagttaggtaaggtgtttttagggttttatttgtgtttttgaagtagcggttttttttcgaatttggtcgatattattaggattcggaagttataggagtaacggttgagggtcgtgttttttattttttatcgagcggaagaatatgaatggtgtcgaattcgtttttcgagtttttttttttttgttcggcggtttaatttattatatgtttcgtttttaggtttcgttgtagtttttcgcggaggtattcggcgttgagttttatggcggtagtttagttggaacggtagtttagtagggatataattttagttcgggcgtcggttacgttattttgttgttttataggagttattttcgttggaaaatttattttcgtttttattaaggcgtacgttaacgtagtattttcgtttttaagtagtcgggttttttagcggtttaggtttttcgcgtttgttatgtgttagttaattagagtttgaggaaggtgggattcgggcggagtcgatgttgaatggtacgcgttcgtcgattggatagtagtttggttttcgcggtcggatttttatattcgtttttagataggagaggggtacgtatcggcgttacggttttttgtaggttgttttcggatagttttcgagagtttgtttcgaagtaagtattttgtagttttagcgatttagtttttttttggattttaggttacggtaattaattttttgttgtggttttcgaattttaaggttcgatgggtttcgcgggggtcgcggcgaggttagggcgttttttcggcgtttatttgttttattgtttgaattttcggtatcggggtcgcgtttacgtggggtttattgttaatattgttcgtcgggtttagtagtataatgggggtcgtaaaaaaggcggggtttggcggattagcgggcgagggttttggtgagagggggaggttttttgtgtcgggaggaaggcgttttagaggaggcggatttcgcggggtataggtttgttgagaaggatcggttaggattgtgatagaggcggggcgtttgtggtggggacggggtttgtcgtaggggaggagcgtgacggggaggcggtgttcggggtattttcgcggcggaatttagggaaggagttagttggggtcggggtgatgatttaggttgggttttagtatagggtttttggtgggtacgttggggtcgggtggaatgtaggagagagaggaggtgggataggtgggtatttgggttggaggtagggtttgaggtgggtaggtgtagagggttgtatttttcggttgaagtcgggaatgaggatttcgttttcgggtgggattggaggggattcgcggttgaggcgttgggttgcgatagggatattatcgtttttttttttagggagatggtgttcgtcgtgtacggtttttcgtttttcgtggtcgtttttcgggtaaggaaggagatcgggtagcggcggtcgggtgagggtttgggtttcgtttttcgtttcgagtcgttttgatgtttttgtacgtcgttcgtagtttgagtgggtttggtagtattcgtacgtttcgcgtcgtttggcgtacgtggggtttcgtttgcgaggagagatagttttcgttttttatttgcgcgtgttggcgtatatgttgcgcgtatcgttttgggttcgtttttcgtttacgttgcgttgggtgcgtttagattttcgttaggatttttgtttttcgtcgtcgtcgtacgtgtttttggttttcgggtttttatcgttttaggtttcggttttaaggcgtcgcgtaggtttttttgatgacgcggagtttgagttagattagggggatttaggggtttgttgttttttgtgcgtttagattatttaggtgaggttttttcgaggaatggatggttttagagtttagacgatttcggatttagtttttttttgagggaaatttattgatacgttttggttattttatttttatttttaagatgttgatgttataggatttacggttatttttgagtaaagtaggttttgtttagggtttttattattttttttttaaagaaaaggtttttttttaggttattagtatttcgttgtattttagtgtggtcgatagagtatgattttttttttttttttttttttttttgagatggagtttagttttgtcgtttaggttagagtgtagtggcgcgatttttgtttattgtaagtttcgttttttgggtttacgttatttttttgttttagtttttcgagtagttgggattataggcgttcgttattacgtttggttaattttttgtatttttagtagagacggggttttatcgtgttagttaggatggtttcgatgttttagtttcgtgattcgttcgttttagttttttaaagtgttgggattataggtatgagttatcgcgttcggttttttttttttttttagatagagttttgttttgttgcggaggttggagtgtagtgattttagtttattggaagtttcgttttttgggtttaagcgatttttttattttaattttttaagtgtgttattatatttgtcgaatgtttgtgtttttagtagggatggggttcgttatgttgggtaggttggttttaaatttttgattttaagtgatttgttcgtttcggttttttagagtgttgggattataggcgtgagttattatgtttggatatgattttgtttttaaaataatgtaatgaattgtagtttatttttgtgtgtatttttttgtatttttttttttttaatatttattattgtttggtatgttacgtgtttttttgattttattagttttttttattttaattgttatattgtattattagagggtagtatttattattgttgtagaataaagttttgtattgagtcgatggtttagaaattttttttttatttatttatttatttttttttttgagatagagttttattttgtcgtttaggttggagtgtagtggcgcgattttagtttattgtaatttttgttttttggttttaagtaattttttttttttagtttttagagtagttgggattatacgcgtttgttatcgcgtttggttaatttttgtatttttagtagagatggggttttaattatgttggttaggttggttttaaatttttgattttaggtgattttgtttatttaagttttttaaaatgttggtattataggtatgagttatcgtgttcggtttaaatatttaataaaataatggacgatgggtgttttttattgagttttcggtaattgtgagtgagtagaggatttgttttggggatatttagtgatttgttgggtgttgttgagttgtgaggaagtttaggtttggttgtagtggtgaggttgtgatttaattaattattgttgatgtttttaggatttgtattagtttagttttaggggtaaggattttaattgtttattttagtttttttatttgtaagatgtaaataatagttatttttgttttatgggatggagttgtgtaatgttcgtaatagtgttt

SEQ ID NO: 269 - DNA, 4448 bp, Artificial Sequence
  chemically treated genomic DNA (Homo sapiens)
aggtattgttgcgggtattatatagttttattttatgaggtaggggtgattgttatttgtattttataaatgaagaaattgaggtggatagttaaaatttttgtttttaggattaagttggtgtaggttttgggagtattagtagtgattgattgagttatagttttattattgtagttagatttgaatttttttatagtttagtaatatttagtaggttattgaatgtttttagggtaagttttttatttatttataattatcgggagtttagtagaaggtatttatcgtttattattttattaaatatttaggtcgggtacggtggtttatgtttgtaatattagtattttgggaggtttaggtgggtaggattatttgaggttaggagtttgagattagtttggttaatatggttgaaattttatttttattaaaaatataaaaattagttaggcgcggtggtaggcgcgtgtaattttagttattttggaggttgaggaaggagaattgtttgaaattaggaggtagaggttgtagtgagttgagatcgcgttattatattttagtttgagcgatagagtaagattttgttttaaaaaaaaaaataaataaataaataaaaagaaaatttttgggttatcggtttagtgtaggattttgttttatagtagtgataagtgttgttttttgatagtgtagtgtggtagttggggtgggagaggttaatgagattaagaaaatacgtagtatgttagataatagtaagtgttaagggaaagggggtgtagaaaagtgtatataagaatgagttgtagtttattatattgttttagagatagggttatgtttaggtatggtggtttacgtttataattttagtattttgggaggtcgaggcgggtagattatttgaggttaggagtttgagattagtttgtttaatatggcgaattttatttttattaaaaatataaatattcggtaggtgtggtggtatatttgggaggttgagataggagaatcgtttgaatttaggaggcggagtttttagtgagttgagattattgtattttagttttcgtaatagagtaagattttgtttaaaaaaaaaaaaagggtcgggcgcggtggtttatgtttgtaattttagtattttgggaggttgaggcgggcggattacgaggttaggatatcgagattattttggttaatacggtgaaatttcgtttttattaaaaatataaaaaattaattaggcgtggtggcgggcgtttgtagttttagttattcgggaggttgaggtaggagaatggcgtgaatttaggaggcggagtttgtagtgagtagagatcgcgttattgtattttagtttgggcgatagagttagattttattttaaaaaaaaaaaaaaaaaaaaagagggttatgttttgtcgattatattggagtgtagcggagtattgatggtttagggaagaattttttttttgaaggggaaatggtgaaggttttgagtagggtttgttttgtttaggaatggtcgtaagttttatagtattagtattttagagatggggatagggtggttaaagcgtgttagtgggttttttttaagaaagagttggattcgaagtcgtttggattttagagttatttatttttcggggggattttatttggatggtttgggcgtatagggagtagtaggtttttggatttttttggtttggtttaggtttcgcgttattaaagggatttgcgcggcgttttggggtcggggtttggggcggtggaggttcgaaggttagaggtacgtgcggcggcggcgggaggtagaggttttggcggaggtttgggcgtatttagcgtagcgtgagcgggaggcgagtttagggcggtgcgcgtagtatgtgcgttagtacgcgtaggtggaaagcgaaggttgttttttttcgtaggcgaggttttacgtgcgttaggcggcgcgaggcgtgcgggtgttgttaagtttatttaaattgcgggcggcgtataggggtattagggcggttcggagcgaggggcggaatttaagtttttattcggtcgtcgttgttcggtttttttttttattcgaagggcggttacggaggacgggaagtcgtgtacgacgagtattatttttttgaggaggagaacggtgatgtttttgtcgtagtttagcgttttagtcgcgggttttttttaattttattcgagagcggggtttttattttcggttttagtcgagaagtgtagttttttgtatttatttattttaggttttgtttttagtttaggtatttatttgttttatttttttttttttttgtattttattcgattttagcgtgtttattaagagttttatgttggaatttagtttggattattatttcggttttagttagttttttttttgagtttcgtcgcggagatgtttcgggtatcgttttttcgttacgttttttttttgcgataggtttcgtttttattatagacgtttcgtttttgttatagttttggtcggttttttttaataggtttgtgtttcgcggggttcgttttttttgggacgtttttttttcggtatagaaggttttttttttttattagggttttcgttcgttggttcgttaggtttcgttttttttgcggtttttattgtgttgttggattcgacgagtagtgttgatagtgaattttacgtagacgcggtttcggtatcgggggtttaggtagtagagtaggtagacgtcgaaaaagcgttttggtttcgtcgcgattttcgcgggatttatcgggttttggggttcgggaattatagtagggggttgattgtcgtgatttagggtttaggggagggttggatcgttagggttgtagggtgtttgtttcggaataagttttcggggattattcggaggtagtttgtaggaagtcgtagcgtcggtacgtgttttttttttgtttggaggcgggtgtagaagttcgatcgcggaagttagattgttgtttagtcggcgagcgcgtattatttagtatcggtttcgttcgagttttattttttttaggttttgattggttgatatatggtaagcgcgaaaagtttggatcgttggaaagttcggttgtttgagggcggaagtattgcgttgacgtacgttttagtaagggcggaagtgagttttttagcggaagtggtttttgtaaggtagtaaggtagcgtggtcggcgttcgagttggggttgtgtttttgttgggttgtcgttttagttggattgtcgttatggaatttagcgtcgaatattttcgcgagaagttgtagcgggatttggaggcggagtatgtggtgagttgagtcgtcggataaggggaaaagagttcggggggcgggttcggtattatttatattttttcgttcggtaggaggtggaggatacgatttttaatcgttgtttttgtagttttcgagttttggtggtgtcggttaagttcgaggggaaatcgttgttttagagatataggtaaggttttgggagtattttgtttagtttttgtattataattttagttattttttttatttttgtaatttgattttcgtattttttttggcgtggtttagggattttgaggatttcgttttcgtgatttttgtttcgagtatttcgatgtagattttttttttaagtacgtgtttttacggtttggggattataattttggggatattagttttttgggttattttagtttcggggtgtgcgattatcgttggtttttttttaattttatttttcgttttaggttggtgaacgcgtgtttagtagaagagttttcgtatatttatgtttttgaatagaaaattttgattttagattagtgggtacgtgagcgatagaaatgagggattgggatttgtatagttattaaattataaatttggattagtttttgtgtcgatgtgtgtgtgggaggggtgttgaggtcgagtttaggatttggtttttttttgttttgttttcgtttattgttttattttggatacgtttttgtttttatttaggtttttatttttgtttgtaaaatgaaagttttatcgtaaaagttttttttagggtttatcgagaaagttttttttttgtaatttcgtttagatatttaggagtttgtattgttattatttatttattttttagagagtttagggttttttttttttgttagtttttaagatgtagagatgagaaagtgatcggggttttagggttttgattagttgaataaatttttttttgatattatcgtagtattagaggtattatatagaattttatatattttttgtaggtttttttcggtttttttaggtttaagagggagtggtgtttaggtaggggtttattaatttttggaatgttga

SEQ ID NO: 270 - DNA, 4001 bp, Artificial Sequence
  chemically treated genomic DNA (Homo sapiens)
gagtttaatgtttgtgatttttttttttttaaaaatttttgaggtaatatttatatttagtgaaatgtatagattttaagtggattattttattagtttgataaatgtttgtaaggtggaatttaagtttttattagtatttgttaaatttatgttagaggttgattagagaagtatagtttttaagatttttattttgttttgcggagaatggtaaaaatttgcgaaatattttagtagagttaggagagagtaatattggtaacgtgaagtacgttaagttaagaaaggaagtattgaaattaattgttttgaatggaatttgataagaatttgttattttatttttttaagattggatttaagttgggagagaatattgttttttgttttgtttaagttaatattattgtttagatttataaatttttttattttttaatgtttatatattaatttgtattataagttaaaataatatagagaatttggaaaaagaagaaggggaatgttttttacgaaaagtatattttttaaagcgtttggtttgagagttatatagtatgtataaaatttgataataagtatattatgatttatattgtatataataaaaagtagggtatttttgaagggttttgagaaaaagttttgggtttttaaaatttgtttaagaaggcgattaacggtatattatttttaaacgtagtattgatttgtatgttttatagttattaatagtgaaaataatagtttttaataagagttggaaatattgagttgagggttttttttttttttttaaagtttgaggttaaaatcgatatttatttttttgaattatgtttatattttttttttggttaatacgtacgcggtggtataattttgaaaattacgtaacgttatagaattattatttagaaacgaattttgttaataaattttttgtatttaaattttttttattgtatagtttttgataatgttttttagataattttttttttagtaattagtatttttaaataaaaattatagagaatagtaagttttttttttttttttcggtagatttgatttagaaattgttatgggaagaaagtgttaattatattaaaaaatagtttgatagaaagtatttaaaaagagaaagggagaatattacgtttttattttggtgaattagtaataaagaaaaagattagtatggacgggtattttttaaaaatatatttttttttttttggttttcgttagggtggaggaagttgtttttttgttagagatagggtggaagagagtgaaaggataaatgattgagaggttgtttttttttattggtgtaggcgtgcgggggtcggatggggggtcgcggaggggggaggtggttagtaggtgtttgggttttaggtttttatttttattttcgtttttatttttatttatatttagggattggtttcgttttttggcgggcgagcggtaggtgtcgaagtattggggtggggggtgtaaatttcgcgggtagcggaaaagaggtcgtggggggttttttagcgttggtagatatcgtgaggttggtagtcgtcggtacgtatatttagttcgtagtttcgaggaatatgttcgtagttagggcgcggagtagagtttcgggtaggagaattaagggagggcgtgtgttgtggcggcggcggtagcggtagcggagtcgttagtttttttttttttgagtgagagaatgttatatttaggaatatagttaattagggaagtgaaagatttttataatgagaattattaaatattgtttaaagaaagtatagacgatattaattaatggaaaaatattttatgattatggataggagagagtaatattattaaaatggttatattgtttagagtaatttatggatttaatgttatttttattaaattattaatgatattgtttatagaattagaagaaattattttaaaatttatgggtcgtgttcggggcgttgttttcgtagtttgcggcgttttcgttcgcgttttcgtagggttttttttgcgtcgttgtcgtcgggggttcgggcgtttgcggttcggcgacggtagtggttgtagcgggtacggtcgaaggatcgggaggcggtggttcggttcgaatcgtcgtgaagaaagcgtaattacgtttcgtttcgcgggttaagaaattggagaaattcggagtgtatttcgtttgtaaggtacgcgttcgtcgttttcggatcgcggatgggtgttaggggtttagttcgcgggatttttttttttttttcgtttttattttcgtttttcgttttttgtttttcgtttttcgtttggggtcgttgtatcgcggaagtgtttttgtcgttcgcgtttaattagtttttttttggataagagttttgttgggtttgaagaagggggattattaagacggagagttttttatttttttcgtttgaaaggagtagtttcggtattcgagttttcgggttattttggggttttgttgttttgtaggagttcgttggagttattttttcgggagtggagcggtgttttttatgtggcgggtgatttaggggtaaggaaaaattttttgggggattgagtggttttttttgtaatcgatttttttttgtgttttattgggaggaattgggtgtaaggagtgggggtggagaagattttcggatttttggcgttttgggaaagcgaaggggaggaaagcgcggggtgggaaggtgggtagagttcgaggcgagggttttgtggtgtttggcgttttcggttgggggcggaggtattgtcgcgcgcggtgatagttttgttattattgtattattatttgtttagttaaaacgttgttttagttgttcgaggtgtaaataggatttggtaaagtgatagtttagcgcggcgggcgttattgtttagtttgaggatatttattttttgttatttattttttatgttagtttaggtattttgttatttttagttgtagatttagatgtggaggttgtgttttcgaggtgggaggattgttcgaggtcgcggggtaggttggttttgcgttgttagtagcggttttgttttgatagggtgatagttgaggggggcggggatttggttttgttagtttttgcggtttgtggttgaggtagggaagagatatatttatatatatttatatttttttgtattttttttgtttgttgtaaagagggttaagtttttagattttagattttcgattgttataattaagttgtagtgattatttttgaattttgatataattataatttattttattagaatatttaggttatattttttttggtatttgtaggagttttttagttataatggaatgtttatgtttgttttttttttatattatatgtttaggtttatgttaagtatttttgtattttatattggtttaataaatatttgttgagtgaatgtaggatttagtttagtgttttttaaattttaatgtgtatgggaattttttggggaagttggttaaaatgttgattatgaattaggtggtttgaggtggaagttgagagtttgtatttttgataaatttttaagtgatgttatgttagtttatagattatattttaatttagatttggataatatattatttgttttttttgattttagtagaaaagatagaaataaataataatgttatgtggttatttttgaagaaggaatgtaaaaaagatgaagtggggagtgtgtttttaagaaaggtgtaagtttaggagttgattatgaagggtattagacgaatgagaataggatatcgattgtagtaggtagaagggcgagttatgtatagaattaagaataaggttatgggtatagggtatattgtttgggtgatgattatattaaaattttataaattattattaaagaatttatgtaattaaatattatttgttttataaaaattt

SEQ ID NO: 271 - DNA, 4001 bp, Artificial Sequence
  chemically treated genomic DNA (Homo sapiens)
aggtttttgtggaataggtggtgtttgattatataagttttttaatggtgatttgtgagattttggtgtagttattatttaagtagtatgttttgtatttatgattttgtttttaattttgtatatagttcgtttttttgtttattatagtcggtgttttgtttttattcgtttaatgttttttatgattaatttttgggtttgtattttttttagaagtatattttttattttattttttttgtattttttttttagaaataattatatagtattattatttgtttttgttttttttgttaaaattaaaggggataaataatatattgtttaggtttgaattggaatgtggtttgtggattagtatagtattatttgggagtttgttagaaatgtaaatttttagtttttattttagattatttgatttataattagtattttaattagtttttttaggagatttttatgtatattaaagtttgaggagtattgggttagattttatatttatttaataaatatttattgaattagtgtaggatatagaggtgtttaatataaatttgagtatatggtgtggaaaaagagtaagtatagatattttattgtgattgagaagtttttgtaagtattaagaagagtataatttagatgttttagtagaataaattatagttatgttaaaatttagaagtggttattgtagtttggttgtgataatcgggaatttggaatttgggaatttgattttttttatagtaggtaggaagaatatagggaggtgtgagtgtgtgtgagtgtgttttttttttgttttagttataggtcgtaggagttgataaggttaagttttcgttttttttagttgttattttgttaaaataaagtcgttgttgatagcgtagggttagtttgtttcgcggtttcgggtaatttttttatttcgggaatatagtttttatatttggatttgtagttggaggtgatagggtgtttaaattggtatggagagtgggtagtaagaaatgggtgtttttaaattgagtagtagcgttcgtcgcgttgggttgttattttgttaaattttgtttatatttcgagtagttgggatagcgttttaattaaataagtaataatataataatgatagggttgttatcgcgcgcggtagtgttttcgtttttagtcgagggcgttaggtattataagattttcgtttcggattttgtttatttttttatttcgcgtttttttttttttcgtttttttaaagcgttaggagttcgggagttttttttatttttattttttgtatttagttttttttagtgggatataggaagggatcgattgtagaagggattatttagttttttaaaagatttttttttgtttttgggttattcgttatatggagagtatcgttttattttcgggaaagtgattttagcgagtttttatagagtaataaaattttaaggtagttcgggagttcggatgtcgaagttattttttttaagcggaaggaatgaagggtttttcgttttagtgattttttttttttaaatttagtaggatttttatttaagaagaagttaattgggcgcgggcgataagagtattttcgcggtgtagcggttttaggcgggaggcgagaggtaggaggcgggaggcggaggtggaagcgggagggggaggggggtttcgcgggttgggtttttagtatttattcgcggttcgagagcggcgagcgcgtattttgtaggcggagtatatttcgagtttttttagttttttggttcgcggagcggagcgtagttgcgttttttttacggcgattcgggtcgagttatcgtttttcggtttttcggtcgtgttcgttgtagttattgtcgtcgtcggatcgtaggcgttcgagttttcggcggtagcggcgtagggggagttttgcgggggcgcgggcggaagcgtcgtaggttgcgggggtagcgtttcgggtacggtttatgaattttaaaatagttttttttagttttgtgaataatgttattggtagtttaataggaataatattgaatttataaattattttgggtagtatggttattttaatgatattgtttttttttatttatgattatggaatgtttttttattagttgatgtcgtttgtgttttttttgagtagtgtttagtaatttttattatagagattttttatttttttggttagttgtatttttaggtatggtatttttttatttaggagggaggggattagcggtttcgttgtcgttgtcgtcgtcgttatagtatacgtttttttttggtttttttgttcgggattttgtttcgcgttttggttgcggatatgtttttcgggattgcggattaggtgtgcgtgtcggcggttgttagttttacggtgtttgttagcgttgggaggttttttacggtttttttttcgttgttcgcggggtttgtattttttattttagtgtttcgatatttatcgttcgttcgttagggggcgaggttaatttttgggtgtgggtgagggtggggacgagggtgggggtaggggtttggagtttaggtatttgttggttatttttttttttcgcggttttttattcgattttcgtacgtttgtattagtgggagggggtagttttttaattatttgtttttttatttttttttattttgtttttgatagagagataattttttttattttagcgggagttagaggaaaaaaaatatatttttgaaaagtattcgtttatgttaatttttttttttgttgttaatttattaaaataaagacgtgatgttttttttttttttttttaaatattttttgttaaattattttttaatataattaatattttttttttatagtaatttttgggttaaatttgtcggaggaggggaaaaaaatttattattttttgtaatttttgtttgaaagtgttggttgttaaaagaaagattgtttaaaaagtattgttaaaaattatgtagtggaaaaagtttgaatataaaaagtttgttaataggattcgtttttgggtggtggttttataacgttacgtagtttttaaaattgtgttatcgcgtgcgtattaattaggaaaaagatataagtataatttaaaagaataaatatcgattttggttttaaattttaaaaagaaaaaaaaaatttttaatttagtgtttttaatttttgttgaaaattgttgtttttattgttgatgattgtggagtatataagttagtgttgcgtttgaaagtggtgtatcgttgatcgtttttttaagtaggttttaaaagtttagggtttttttttaggattttttagaagtgttttattttttgttatatgtaatgtgggttataatgtgtttattattagattttatgtatgttgtatagtttttaggttagacgttttaaggggtgtgtttttcgtgggaaatatttttttttttttttttttagattttttgtgttattttgatttgtaatgtaggttaatatataaatattgggaggtgggggagtttgtagatttaaatagtgatattagtttagatagggtaaaaggtaatatttttttttaatttgagtttagttttgaggggatgaaatggtagatttttattaggttttatttaggataattaattttagtgtttttttttttagtttgacgtgttttacgttattagtgttatttttttttggttttgttgagatgtttcgtagatttttgttatttttcgtaaagtagggtgagagttttaaaggttgtgtttttttgattaatttttaatatggatttaatagatattaataagagtttgggttttattttgtaggtatttgttaaattgatggaatgatttatttgagatttgtatattttattggatataaatgttgttttaaaaatttttaaaaaaagaaaaattataagtattgaattt

SEQ ID NO: 272 - DNA, 4322 bp, Artificial Sequence
  chemically treated genomic DNA (Homo sapiens)
ggtaagtcgttttttttttttttgagttttagtttgtttattattaaaattggtattaatagtagtttttattttttgagaattgtttagattgtttatatttagtatttagtatatagtttggtgttgggtagtttttattagcgatagttatgattatttattttttttttttatggtgaattatacggagtgggaataaaggtttggtggttggatttggagttttttaagggttagttttttttttggttgtagtttttggtatagggtgggtttattgtttatgttgagggagagattgggttggtttattgtggatttgaaggaggagttagaaggaaattcgattttaagtgggtaaaggttatttgaggtttattttgtttatttttttttttagtttaattttagggaagttatggggtatgatgggtggggtgggatgggattaggatatagaatatgttaatgaatatggttttttatttagggaagtgtcgtgtattataattgggtattagggaggagggatatttgaatggatataattagggtaggtagaggtttgggggtggggtgggaaatggtatttaggtttagagaatagtatgtttaaggtttgggtgtgaagagaaagttttttttaaaggatagtttttgaatttatttggtttggttttttttttttatttatttttcgtaattttaattagggtttttttatttgaataacgtggtagtttttttgttttttatttagttttttttttgttttgttgtttttttgttttatttatttcgtaggagtttttttgagtttgttattttgtttggttgtaatagtttttattatttttttattgttttgtgagaagattaaagtttaatggtttgtttttgttataagttttttttttagtttaggttattttagggattgttttttatttttattttttgtgttttagttgggaagagttgtttagattttttttattttttttaggtggttttttaggatttggaatttttttttttgttttttgggaagtgatatttttttggatgagtataaggttaatgttttggttttttgagttttggggataggggaatggattttttagaattttaattggtttttagattttgagtttaggggatattcggtgaatagatgaatgagtgaatgaatgaatgaaggagttatggttgataattaagttttatgtttggaaaggaggtttaggcgtttgttaggagtaatagagaggttttaaaggtgggggtaggaaagtagaagattgttaatcggggtaggggtaattgttagttcgagtaggggtagtttttagaatcgtttgaggagtagtgtagcgttcgattagcgagaattttcgattttggagtttaattagtttagtttttggggtagagtcgggatagcgggtttggcggcgggtatcgcgttcggtcgcgttcgagttttagttaataggaagagtaggagtggggttaggagaggcgggttagttggttagtggggagtttcgggcgtgggtgtggggagcgggggaattttcgtcggttttttttaggttttagcgggcggagggagtttttttatcgggttttagcgtttttttttgtaaaatgggttttttttgagggttggttgcgcgttaatggcgggaggatgcgaagagggttaggtagggtagagggatcgggagattcggtgtttcgcgtaggtagaggcggagggacgttgttttcgattgtagttggcggggcgaggtttggtagggcgaggtttggcgggggcggggtttggcgggggcggggtcggcggtatttgggtgaggtcgttcggtttcgttttttcgtattttcgtgtgtcgcggcgtcggagttcgaggcggttgtagtttatatttttcgagcgattttcggcgttcgttcgtcgcgcggaggttcgggttatattttattggtcgtttggtttattttagttagcgtcgcgtcgaatttcgttcgcgcgcgtcggggagcggcgttttcgtcgttgtcgtcgcgatttttggcgtttgtttttgtaacgggaggtaagtgagggtcgggttcgggcgcgggatcggggttatttcgagggcgcggcgttttttttttttttttttcgttttagttttcgttttcgaaattgagaaattgagtcgcggttagcgaaagtttcgtcgcgtcgagatttgtcggtgatttcgtttttttgttcgtttgtgtgttttttcgttagatagtgggggttgaggtttttttgtttgttcgttttcggtttttttattcgttcgtgtgtttttcgttttttcgaggggttcgttcgtttttttcgattttttttcgggttttgtgttcgttcgtttgtcgttatttattttgtgttttttttttgcgcgttttttcgagattcgatttttttgtttttcgttattcgattcgttcgttttttgtttttcgcgtgttttatcgttttatttttatttatatttttattttcgttcgtcgttttttcgatttcgttttttcggagtcgcgttttcggtttacgttcgtcgttttttgttagtttagtcgttttttcgttttatcgcggggtttaggttaggtcgttcgtcgggtttcgtttttcgtttttgggtttttggaggttcgattcgcgcggcgtttttttttcgttgttttttttttcggttttaagagtttttttcggtttttttattcgtttttgggttgggcgtggttttagtttttattatttttttttttattttattttttcgtttttttgagattttttttagggtggtttttgttcgatacggtttgtattcgtttttaatttagatgttattttcgttgtgggggttttattagatgaggggaggaggtcgggggggggggtttttttggttggtggtggagcggtagaaggagagtattatcggaattgtttttatttttttagtttttttttttttggggtaggggagagttttatcgagtttcgttttaaatttggttagaaggatttgttgtgagtgggcggggggtttttttttttgacgtttattttgtatgcgtggaagttgtttttttgtgttaagttattggtatttgggtgtgtgggtatgttgtgtgtttgtgttagtttttgtgttgtttgttattgtgggatttgtttgtgtatgtgtgttttttttcgtatgtgtgatttgtttgtgtgtatgtgtgtatgtttgtttgtgttttgaggttttgtgtgtgttttttgtaattgtgtgtattatttttggtgtgtttgttgttattagattcgtgtgtgtgtgtgtgtgtgtgtgtgtttttgtttgttagtgtgtgtgtttttgtgtgtttggaggtttcggtgttgtatattgggtatattatggtgattaattggttatgagtacgttagatttgttaattgtggaagtttttggtgttgggtgtttatttattagttttatgtgtgagtgtatttgtataagtgtgtgtatgtgtgtgtatttacgtgtggttttttttttgttattgagtttttgtgattaggtttatttggttattaagggaggggattgatttttggggttttttcgtttttgttgtggagtgagttggggtttggtgagtaggttagtagagggaggttgtatggtgtatgtgtgatatgtgtggttgtgtgtgtgcgtgtgtgtgtgatagagaggtgtggtggtgtttgggtagttgtatttggttgatgggtggtgtgagggttatgcgatgggatagtgttggggtaagtttgggagtgtgtggttacggtaggagtgtgtgattggtgggatatagtttatgaaattgtcggtgtatgtttggggagtgattgtgattgtggggaatcgagagtgtttgggcgtgggtgttagcggtaggagggggtgtgataaggtgtgtggtgatagtgttgggagggaaggtgagagtttagtgtgggggtgtgtgtgtgagtgtgtgggagattatgaggatgtgggtgtgtatatggagagggttagagggtaagttttggggtttgtagtgttgtgattaagatttcgggttttgtatttaagaattatttgggttttaatatttgtttgtgtttgttaagagtaagagatttaagttaggttttttaaggttgagtgtttttatttgtagaatggagagagtgaggataaaagtttttgtgttaaaggttttttaatataattttggtt

SEQ ID NO: 273 - DNA, 4322 bp, Artificial Sequence
  chemically treated genomic DNA (Homo sapiens)
ggttaagattgtgttaaaggatttttaatataggaatttttgtttttattttttttattttgtagataaggatatttagttttgagaggtttagtttgggttttttgtttttaataggtataagtaagtattggagtttaaataatttttgggtatagagttcgaggttttggttataatattataaattttaagatttgttttttagttttttttatgtgtatatttatatttttatggttttttatatatttatatatatatttttatattgggtttttatttttttttttagtattgttattatatattttgttatatttttttttgtcgttaatatttacgtttaggtattttcggttttttataattatagttattttttaagtatatatcggtagttttatagattgtgttttattagttatatatttttatcgtggttatatatttttaggtttattttagtattgttttatcgtatagtttttatattatttattagttaggtatagttgtttagatattattatatttttttgttatatatatacgtatatatataattatatatattatatatgtattatatagtttttttttgttggtttgtttattaagttttagtttattttatagtaggaacgaggaaattttagggattagtttttttttttagtgattaggtgggtttggttatagaaatttagtggtagagggagagttatacgtgagtatatatatatatatatatttatatagatatatttatatatgagattggtgggtaggtatttaatattaggggtttttataattaatagatttaacgtatttatggttagttggttattatgatatatttagtgtgtaatatcgaaatttttagatatatagggatatatatattagtaggtaaggatatatatatatatatatatatatacgagtttggtgataataaatatattaagaatggtatatatagttgtaaaagatatatatagagttttaggatataaatagatatatatatatatatataagtaagttatatatgcgaaaaaggatatatatgtataggtaagttttatagtgatagatagtatagaagttgatatagatatataatatatttatatatttagatattagtgatttagtataaggagatagtttttacgtatatagggtaggcgttagagaaggggatttttcgtttatttatagtagatttttttgattaggtttaaggcggggttcggtggggtttttttttgttttaagagagagggaattggggaagtgggagtagtttcgatggtgttttttttttgtcgttttattattagttaggaggattttttttttcgattttttttttttatttggtggagtttttataacgggagtggtatttgggttgggggcgagtatagatcgtatcgggtaggggttattttgggaggggttttagaggggcggaggggtggggtgggaagggggatggtggagattggagttacgtttagtttagagacggatgaagggatcgagaaagatttttgagatcgaaagaagagatagcgaggaggaggcgtcgcgcgggtcgggtttttagggatttaggggcgggaggcgaggttcggcgggcggtttggtttgggtttcgcggtagagcggagaggcggttggattggtagggggcggcgagcgtgggtcgggggcgcggtttcgggaggacgggatcgagggggcggcgggcgggggtaggggtgtgggtgggggtggggcgatggagtacgcggagggtaagggacggacggatcgggtggcgagggatagaaggatcgggtttcggagaggcgcgtagggggagaatatagagtgggtggcgatagacggacggatatagggttcgggagagagtcgggagggacggacgggtttttcggaggagcgggagatatacgggcgggtggaggggtcgggagcgggtagatagaaggattttagtttttattgtttagcggagggatatatagacggatagggggacggagttatcggtaggtttcggcgcggcgggattttcgttgatcgcggtttagttttttagtttcggaaacgggaattggggcgggaagggggaaggaagggcgtcgcgttttcggggtagtttcgatttcgcgttcggattcggtttttatttatttttcgttgtaggggtaggcgttaagggtcgcggcggtagcggcgggggcgtcgtttttcggcgcgcgcggacggggttcggcgcggcgttgattgggatgggttaagcggttagtgaggtgtggttcgggttttcgcgcggcgggcgggcgtcgggggtcgttcgggagatgtgggttatagtcgtttcgggtttcggcgtcgcggtatacggaagtgcgagggggcggggtcgagcgattttatttaggtgtcgtcggtttcgttttcgttaggtttcgttttcgttaggtttcgttttgttaggtttcgtttcgttagttgtaatcggggatagcgttttttcgtttttgtttgcgcgggatatcgagtttttcggtttttttgttttgtttggtttttttcgtattttttcgttattagcgcgtagttagtttttagaaggggtttattttatagaggaggacgttgaggttcggtggggaggtttttttcgttcgttggggtttgggaggggtcggcgggggttttttcgttttttatatttacgttcgggattttttattggttagttggttcgttttttttggttttatttttgttttttttgttggttggagttcggacgcggtcgggcgcggtgttcgtcgttaagttcgttgtttcggttttgttttaaagattgagttggttagattttagggtcggaggttttcgttggtcgggcgttgtattgttttttaggcggttttgggaattgtttttattcggattggtagttgtttttatttcgattggtagttttttgtttttttgtttttatttttgagatttttttattgtttttggtaggcgtttgagttttttttttagatatggaatttggttgttagttataatttttttatttatttatttatttatttatttatttatcgagtgttttttaggtttaaagtttagggattagttggggttttagggagtttatttttttgtttttagagtttagaaagttaagatattagttttatatttatttaaagaaatgttattttttaggagataaaaaagagggttttaggttttggggaattatttagaagggatagagaaagtttagatagttttttttagttgagatataagggatggaagtgggggataatttttgaggtggtttgagttgagaaaggggtttgtgatagagataggttattggattttggtttttttatagagtaatgagaaggtggtgaaagttattataattaggtaggatgataggtttaagggggtttttgcgggatagatggggtagagggatagtagggtagaggagaggttggatgggggatagaagggttgttacgttgtttaggtgggaggattttggttgagattgcggaagatggatggggagaaaaggttagattaggtgggtttaaggattattttttgggaaagattttttttttatatttaggttttgagtatgttgttttttgggtttgaatgttattttttattttatttttaaatttttatttgttttggttgtgtttatttaaatgttttttttttttgatgtttagttgtaatgtacggtatttttttgagtgaaggattatatttattagtatgttttgtgttttgattttattttattttatttattatgttttatggtttttttggggttggattggaggaaagggtaaataaggtgagttttaagtgatttttgtttatttgggatcgggtttttttttggttttttttttaggtttatagtaagttaatttagttttttttttaatataaataataggtttattttgtgttagggattgtagttagagggaggattgatttttgaggagttttaggtttagttattagatttttgtttttatttcgtgtggtttattatggaagaaggaaatgaataattatggttatcgttgataggggttatttagtattaggttgtgtgttgggtgttggatgtgggtagtttgaatagtttttaagaggtgagggttgttgttagtgttagttttggtgatgagtaaattgaggtttagagaaaggagaagcgatttgtt

SEQ ID NO: 274 - DNA, 8467 bp, Artificial Sequence
  chemically treated genomic DNA (Homo sapiens)
atgaattaaatttttttttggtattaagaagggatatatagtatttcgagttttgtttttgtttttttattaagttttttttaatagttggaagtggttgaagggggttgttttaaggagattttttgttttttttttgatagttgattaaaagaaaataggttacgttttttaaatttatgtttattttgtttttaattattgtttttttaaataaaggtaatatttgcgtaattttagttagtttgaattttcggaggtaaatagagcgtaatttgttttggaagaattttgttacgtttaaggttttatgtcgggtgttggtttttttgtttttaattatttttttatttcgattcggattgtagaaatttttaattttttgttttttagttttatttttatttttagatttggggttgttaaataacggaaattttaggaagacgtaggtgcggtttttaaagttttggtttgtgagcgtttttaggttggtcggggcgttggtttttttagaaataaggtttgaatatgtaggtgttagttaggattttttgtcgtttgtttatcgtcgtttttttttcgggatttgagagaagcgggagtgtgtgtgtgtgtgtgtgtgtgtgtgtgtgcgcgtgtgtgtgtttcgtgttaggagaaaggttcgtggttgtcgttttagttggtttgtttattttttgtttttaggagaagtttgtttatttgggatattagcgattttttttatttttattttatcggttttatattttttttatttttttttaagtcgttgatgtagaaagtatttggttattttgaaacggtagttttcggaattttagttttgttttgtaatttagtagggtttttcggaagttttataattgagatttatgggtttatcgggtaattaaatgatgttattgtgttaattttgtatgtattattgttgttcgcgtcgttcgtgggtcgtcggtcggtcgtagttcgttggcgacgagggtattatagttgttttgatcgcgtagattatgtatgtttcggtttcgggaatttattatgtattagaatatattagcgtttgtattttaaaaggttaaattattggtttttagttagggattttcggtaagtggtttgttagtgacgagtgtttgtttatattggtatatagcggagttttttgttttcggtttattcgtttttaggaaagttttggggtgaggcgaaggcgattgaagtaatgtttttttttttagatcgtagttgtttaggggggatatagtacggtattttttatcgaatttttttcgttcgttcgtattttagtttttttttttttagcgatttttttatttttttttttttttttttttttgacgtttgattttagtagtaaaggaggtaaaaaaggtatcgagtcgttagttaaatttgaaaagtgcggtttcgttttttttatagttattggtagtttttcgtggaaggttcgtttttcggggtagttgcggtttcggagtggttgcgtttggcgttcgtcgggcgtggtttcgttttaggttcgggagggtaggttggttgtttcggcgagcggtagagtttttttggatagttttcgtttatttaaatagaagacgtcggcgtcggagcgggttcggatatggcgaggttgcgagtcggttcgagcggcggggttcggtgattttttttttttttttcgtttttttttttttttcgtacgtacgtttcgttcgtttttatttcgtttttatttcgggcgagttcgttcgtagttcggggcgtatattcgtacgcgtatttttttttatttattttcgcgttcgtttttattttcgtagtcgagtttcgttacgcgcgttttgttcgttcgtcggtcgttttcgtcgttttcgtcgttttcgggttttgatggattgaatgaaggttgtttatatcgtttatcgatgttttattaaagatttagaaggttgcgttatgaattcggagttgataatggaaagtttgggtattttgtacgggtcggtcggcggcggtagtggcgggggcggcggcgggggcggcgggggcggcggcgggggttcgggttatgagtaggagttgttggttagttttagtttttattacgcgggtcgcggcgtcgttggttcgttgcggggtttttcgtcgtttttaatcgcgtattaggagttgggtacggcggtagcggcggtagcggcggcgtcgcgttcggttatggttattagtatggtttcgattttggacggcggcgattatcggttcgagttttttatttcgttgtattacgttatgagtatgttttgcgattcgttttcgtttggtatgggtatgagtaatatttatattacgttgatatcgttttagtcgttgttatttatttttatcgtgtttgataagttttattatttttattcgtattattattcgtattattattattattattattattagcgtttgttcggtaacgttagcggtagttttatttttatgcgcgacgagcgcgggttttcggttatgaataatttttatagtttttataaggagatgttcggtatgagttagagtttgttttcgttggtcgttacgtcgttgggtaacgggttaggcggtttttataacgcgtagtagagtttgtttaattacggttcgtcgggttacgataaaatgtttagttttaatttcgacgcgtattatattgttatgttgattcgcggtgagtaatatttgtttcgcggtttgggtattttatttgcggttatgatgtcgtatttgaacggtttgtattattcgggttatatttagttttacgggtcggtgttggtatttagtcgcgagcggttattttcgtttttatcgggttcgtaggtggttacgtcgggttagttggaagaaattaatattaaagaggtggtttagcgtattatagcggagttgaagcgttatagtattttttaggcgatttttgcgtagagggtgttgtgtcggttttaggggatttttttcgatttgtttcggaatttaaaatcgtggagtaaatttaaatttggtagggagatttttcgtaggatgtggaagtggttttaggagttcgagttttagcgtatgttcgttttacgtttggtaggtaaggtcggggttagttaggggttaggttgttgggaagagggtttcgggttcggtgtttgtggtttaagtttgcgcgtcgagttattttttttgatttttttttttttttttttatatacgtttttttttttttcgtttttatttttttttttattttttttttttttttcgttttttttttatttttttttttttttttttttttttttttttattttttttttgtttttgagtttttattgatcgatttttttttattttattcgttttttttttaatgtgttaatttttgttttattttcgatttttttaggtattgggaggcgggatgggggtgtgcgtttttttttaggagttttgtttttttaagatttatagaaattaggatttgtttttatttaaaattttatgtattttaagttttttttagataatatattttaatttttcgggttgattagtttttttgtgtagaggtagttgagaggttttgttttgtagagggaaaagagttttttatttttttatttattatataggtaaatttatttggttattggttgaaggtatagttttgttttcgcggggaatcggcggttaggatataatagcgtttttggagtttatttttggttttggcgttggcgtagggattttttgatcgggtttgaggggttcgggttagttttaatgttattatttatagcgagggtagggtgtaaggttgagaaggttatatttatcgttttgggaggacgtgggagaagagattgaggtggaaagcgttttgttttgtttatcggtcgtttttgtttcggttttagcgtttgttgggatttgttaggatttgtcggggtttcgggagattttgagtattcgtaggaagaggtgttgagaaattaaaaatttaggttagttaatgtatttttgtcgtcggttgtaggtttcgtttttgtattaagcgggcgttgattgtgcgcgtttggcgatcgcggggaggattggcggttcgcgggaggggacgggtagaggcgcgggttatattgttttggagtcggttcggttttttgtgttttttttagcggttaagttgcgaggtatagttttttattgttttaggagtatagaaattttttgtgtgggcggcgggtgcgcgagttagagggaaagatgtagtagttattgcgattggtacgtagttgcgcgtttttgtgcgtacggatttcgcgcggtgtgcgtggcgattgcgttgtttttaggagtaagttacgggtttagaggggtaaaatgtttaggtttttcgttgggaaggatatattatattttatggtaagttagggtgggcgattttttatggatcgggtggaggggggtattttttaggatcggcgggcggtttaggggaataattcgtggtggcgatgatttgtatagcgcgggttttgggatgcgcgcggtttcgagttagtttcgtatagttcgttttcggagttgcgagtttaggtttttattttcgatttttcgggtttttttcgtatcgttgagtttagtttgtggggtgtattcgattaacgttcgatagggttggggaatgtgataggtagtaggtttattcgggtttggggagggggagttttcgttttgatagtatttttttttgtcgtttgttggtggatttttatttttagtcggtaatcgtttcgtagtgttgatttaagaaggtaaagaaaattaggtttttttgtaaagagttttttttaaatcggcggatttcggatattttgagtggatttagaaatttatgtaattttttttttttagtttattttttatttttttttatagttttttttgatttgttgttggttcggggtaagataaagtagttagtagagagcgataataatagcggcgggaaatgaattggagattggttgatagtttttaatattttgttatagattttttcgaatgttttaggttgtttttggtgggttttagtattcgtcggttttttgggtatcggggattagaaggaatttggtagttggttttaggggtatagttaaaggtaggatgatagttatttttttgtttattttagagcgttgtcgtttttttatgtcggtcgcgtaaagaatatagtttttaaaaaatacgtgttttttgtttatataggtttgaaagtgatgaggaaagtaatgtttcgtttattagcgagttttagtttttaaaatgattttaagcgttgttgagatgagaaagcgtggtatttcgggggtttttagttttattcgcgtttatggtgtaagtttgtagggataggttcgggatagtattgtttacgttgttagatttttcgtagaggatcgttgaagttgttttcgtgggagatagaatgttttttttagcgagtggaaaaggtttgttgaggatttcgttttgttcgagtatttaaatgtgtgtttgttttattattttgggttgaaaagggataagagttttagtttttttatttggttattttattagtaattataagtgtgttgagtggttattattatataggaggttttttagtttggggttagtagattagtttttttagatattgatgtagaagttgggattggtaagtaggtattatgtgttcggagcgttaggggataggagtaaatggagaagaaaagcggaggtttttttcgttcggagtatcgatcggaattttcgtcggtacgtcgtagagggttttcgtcgttgggtttcgggggtttaataagtttagtcgtttcgtaggcggttcggtcggatttttagatcggtgtttggaagatatcgtttttgtttttttttcgttaaatttgtttttttttttttttttataggttataggtttttttttttttttattttggtttcgttttcgggttttgttaaatagttaagtaggtcggggtttagggggtttagaatgaagaggtttgatttggttagcgtcggtaaagtttatttttaggcgaggttataatagaggtaggttttttttgtttagtttgtcggtgtagttatagttaagggtggtatttgaaaggaaaagggagaaaatttcggagaaatttagattgttttaacgttagattttagagaaattgattttaaatgtacggattcgttcggaaagggcggttaagtggtaggtggttgtaatttcgttcggtcgggttttcgtagaggttttttaagattagtttttgtagggcggtttttagtaatttgataagaggcggttaagataaatttttgcgggttcgagtatatattttcgggcgttgggttttagagatttttaaattaagtataaataagaagggagtgagagaatttaggttagaatttgtacgggtattttattgaggaaaagcgaggtttcggtggtaggtatgttttttttcgacgttcgaaaatcgagtcgagcgttcgattatatttattgtagaggttttcgtttttagtgagttcggattttttagcggtttgttcggagttggtttttagttttcgtcgtagttcgacgtacggtttttttttggtagtaagtttttagcggttagtttgaagttaattttgtttaggcggtcgagggtttttagttaatttattatgatgtcgtttgggttatttgatgttcgtagcggcgggatacggttcgggtagtgcgtagtggtttttgttaggggtatcgcgtgcgtgtttgtttttcgttgcgtcggggacgtttttgggtgatacgggtcgttgggtattttttaagtcgaggaaacggatttttttcgtagagtttcgcgtttattttttaattttttatttcgtttttcgttgttagggttttcgatttagtttattttttttggcggtttagttagggattagagttggagaggttgaacgtaattcgtgttagtacggaatagacgatatgtttgtttgttagttgtttggatgaataattgaaaagttcgttgtagtttgtgtttcgttaagtttcgggtgtcgggagaatatttttttaatacgtattagggtgggcgggagcgggtagaggaggcgggattcgagggaggagagtgaattcgagtaggagaagtagtttaggtagttaggcgttttcgatgcgagaggttgggtatttatttttattttaggttttttattgtgtggttatgttatttttttaaataaatgtgtatatggagggagatcgatgttgataatgtttagaagattaaaagagtattaatgttggtaataataacgtaaacgtgtggatttagattttattgatttggaatttgattcggcgcgtttttagtaagttcgacggcgcgttttttttagtagagcgtttattagcgttacggtttcgcggttttttagcggtgtcgtttcgttagttttgcgcgggttttttcgtttgatcgtagtttttttttcgcgaggttttagttcgttttattttttcgaggttttttttttttttcgcggggttttttgttttttgtattttttttttcgatttttgtattattcgtttttgtgcgtatatatcgttatttgcgttttcggcgattcgtttgggcggttgggttcgcgaagttaatgcgttgaacggtgttcgagtttttttaattattttgtgtttggtcgttgttattgggttttggtgattaagtttaagtttgaaaatgacgtggttaaagttgtttgttaacggtagagtttaattagtcgtagatttttttttatttttatcggttttcgtattaaaaaggtttacgcgtagattttttacgtaggtgtattcgttggataattaaacgtggttttagtaataaaagtttgagttttattttttcgagtagtaggttttgcgttggattggtcgggtttaatagggagaattttgtgttttattttggttgggataggaagtaagagaagtaaattggggaatttttgttttatttttttttattttttggacgttttgggtcgaggttcgggttattggtttatcgcgggtaaggaggtgttttgtggaatatttgtattgattggaaaagaaagaattttaaagtttttttttttcgtttgtgggggatattattatattttgttaattatttttttggttaaatggtggtttgtttttttagaaggagtattaaggtgaattttatggaaaaaaaataaaagattagggatttaagtgggagtaggatgagaattaattttt

SEQ ID NO: 275 - DNA, 8467 bp, Artificial Sequence
  chemically treated genomic DNA (Homo sapiens)
aagaattagtttttattttatttttatttaggtttttgattttttattttttttttataaaatttattttagtgttttttttggaaaaataagttattatttggttaggggagtggttggtagggtgtggtggtgttttttataagcgggaaggaagagttttaaagtttttttttttttagttaatgtaggtgttttataggatatttttttattcgcgatgggttagtgattcgggtttcggtttaggacgtttagggggtgggaaggggtggggtaggggttttttagtttgttttttttattttttgttttagttaaggtaggatataagattttttttgttagattcgattagtttagcgtagagtttgttattcggagggatgaagtttaggtttttgttattagggttacgtttaattgtttaacgaatgtatttgcgtaaaaagtttgcgcgtgagtttttttagtacgagaatcgatgaggataggaggggatttgcggttgattaagttttgtcgttagtaggtagttttagttacgttatttttaaatttgggtttagttattagggtttagtggtaacggttaagtataggatagttaggaagattcgggtatcgtttagcgtattggtttcgcggatttagtcgtttaggcggatcgtcggaagcgtaagtagcggtgtgtgcgtataggggcgggtggtgtagaggtcgggggagggggtgtagagggtagagagtttcgcgagaggaggagaaaatttcggggaagtaaggcgggttggggtttcgcgggggaggagttgcggttagacgggagaattcgcgtagagttggcgaagcggtatcgttggaaaatcgcggggtcgtggcgttggtgagcgttttgttgggaagagcgcgtcgtcgggtttattggaaacgcgtcggattaagttttagattaatgaaatttgggtttatacgtttacgttattgttgttagtattaatgtttttttaattttttaaatattattagtatcgatttttttttatatatatatttgtttgagaaagtgatataattatatagtggaaagtttggaataaaaataaatgtttagtttttcgtatcgagggcgtttggttgtttgggttgttttttttgttcgggtttatttttttttttcgggtttcgttttttttgttcgttttcgtttattttgatgcgtgttgggaaggtgttttttcggtattcgggatttgacgaagtatagattgtagcgaattttttaattatttatttaagtagttagtaggtaaatatatcgtttgtttcgtattggtacgggttgcgtttagtttttttagttttgatttttaattaaatcgttaggagaggtgggttgagtcgggagttttagtagcgagaaacgaggtgggaggttggggggtgggcgcgagattttgcgaagggggttcgttttttcggtttgggaggtgtttagcggttcgtgttatttaaggacgttttcggcgtagcgggagataagtacgtacgcggtgtttttagtaggagttattgcgtattgttcgggtcgtgtttcgtcgttgcgggtattaggtggtttaggcgatattatggtgggttggttaagggttttcggtcgtttgaatagaattggttttagattggtcgttgggagtttgttgttaggagagggtcgtgcgtcggattacggcggggattggagattagtttcgggtaggtcgttgggggattcgggtttattggaggcggaaatttttgtagtaaatgtagtcgggcgttcggttcgattttcgggcgtcggaagaaaatatgtttgttatcgaggtttcgtttttttttagtgggatgttcgtgtaagttttagtttgggtttttttattttttttttgtttgtgtttggtttagaggtttttggggtttaacgttcgagagtgtgtgttcgaattcgtagaaatttgttttggtcgttttttgttaggttgttgaaaatcgttttgtaagggttggttttggggaatttttgcgaaggttcgatcgggcggggttgtaattatttgttatttagtcgtttttttcgaacgaattcgtgtatttggagttaatttttttgaaatttaacgttggggtaatttaaattttttcgaagtttttttttttttttttttaagtgttatttttggttgtgattatatcggtaggttgggtaggaaggatttgtttttgttgtgatttcgtttaagggtgagttttgtcggcgttggttaaattagatttttttattttgagttttttaaatttcggtttgtttggttgtttggtaggattcgggggcggggttaaaatgagagagaaagggaatttataatttatgagagaaagagaagaggtaggtttggcgggaggggggtagggacggtgttttttaggtatcggtttgagagttcggtcgagtcgtttgcggagcggttgggtttgttaaattttcggggtttaacggcgagggttttttgcggcgtatcggcggggatttcgatcgatatttcgggcggagaaagttttcgttttttttttttatttgtttttgttttttagcgtttcgagtatataatatttatttattagttttagtttttgtattagtgtttgaagagattgatttattgattttaaattgaaaagttttttatgtaataataattatttaatatatttgtagttgttgataaaatggttagataaaaaggttaaagtttttgtttttttttaatttagggtaataaaatagatatatatttgaatgttcgagtaaagcggggtttttagtaggttttttttattcgttggaggaggtattttgttttttacgaaggtagttttagcgattttttgcggaaaatttagtagcgtgggtagtgttgtttcgggtttgtttttgtagatttgtattatgggcgcgggtggggttgaggattttcgggatgttacgtttttttattttagtaacgtttgggattattttaaaagttgaaattcgttaataggcgaagtattattttttttattatttttagatttatatgggtagaaggtacgtgttttttaaaagttgtgttttttgcgcgatcggtatgagggggcggtagcgttttgagatgagtaggagaatagttgttattttgtttttaattgtatttttaagattagttgttaagttttttttggttttcggtgtttaagaagtcggcgggtattaaaatttattagagatagtttgggatattcggggggatttatgataaaatgttaagaattgttagttagtttttagtttatttttcgtcgttattattatcgttttttattggttgttttattttgtttcgaattaatagtaaattagagaaaattgtaggagaggatgaaaaataaattaaaggagaaagattatataaatttttaaatttatttaaagtattcggagttcgtcgatttgggggaggttttttgtagggaaatttagttttttttatttttttagattaatattgcggggcgattatcgattgggaataggaatttattagtagacggtaaaggaaaatgttgttaaagcggaaattttttttttttaagttcgggtgaatttgttgtttgttatattttttagttttgtcgggcgttggtcgagtgtattttataagttgggtttagcggtgcgaggaaagttcgggggatcgggggtggaaatttgagttcgtagtttcggaagcgagttgtgcgaggttggttcggaatcgcgcgtattttaagattcgcgttatgtaaattatcgttattacgaattgtttttttagatcgttcgtcgattttgaaagatatttttttttattcgatttatgggaagtcgtttattttggtttgttatagggtatagtgtgttttttttagcgggggatttggatattttgtttttttgggttcgtggtttgtttttaggggtagcgtagtcgttacgtatatcgcgcggggttcgtgcgtataaaagcgcgtaattgcgtgttagtcgtagtaattattgtatttttttttttagttcgcgtattcgtcgtttatataggaggtttttgtgtttttagaataatagagggttgtatttcgtagtttggtcgttagaggaggtataaagagtcgagtcggttttagaataatgtaattcgcgtttttattcgttttttttcgcgggtcgttagtttttttcgcggtcgttaggcgcgtataattagcgttcgtttaatgtaaaggcggagtttgtagtcggcggtagggatgtattaattaatttgaatttttaattttttagtatttttttttgcgagtgtttagggtttttcggagtttcggtaaattttggtaaattttagtaaacgttgggatcggggtaaggacggtcggtgagtaaggtaaagcgttttttattttagtttttttttttacgtttttttaaagcggtgaatgtgatttttttaattttatattttgttttcgttgtaggtagtgatattggagttggttcgagttttttaagttcggttagaaagtttttgcgttaacgttaaggttagagatgggttttaggagcgttgttgtattttggtcgtcggtttttcgcgggggtaaggttgtgtttttagttaatgattaaataagtttgtttatatggtgggtgggagagtagagagtttttttttttttgtagagtaaagttttttaattgtttttgtatagggagattagttagttcggaaaattgaaatgtgttgtttaaaagagatttgaagtgtatggggttttgaataagggtaggttttggtttttgtgggttttggaaagatagggtttttagaggaaaacgtatatttttatttcgttttttagtatttgggaagatcggaaatagggtaaaggttggtatattgaggggagggcgaatgaaatgggggggggtcggttaatgaaagtttagggataaggagagagtaagaaagaaaaagaaaagggagaagggaaagtaggggaagagcggaagagaaagagaaaatggaagaagaaataaaaacgagaagaaagaggacgtgtataggaaagagaaggaaagaattaagagaagtgattcggcgcgtagatttgggttataagtatcggattcggagttttttttttagtagtttggtttttggttagtttcggttttatttgttaggcgtaaggcggatatgcgttggaattcgggtttttgaagttatttttatattttgcggaaggtttttttgttagatttgagtttattttacggttttggatttcggagtaggtcggagagagttttttgagatcggtatagtattttttgcgtaaagatcgtttgggggatattgtagcgttttagtttcgttgtgatgcgttgggttatttttttggtgttgattttttttagttggttcgacgtggttatttgcgagttcgatgaggacgagggtggtcgttcgcgattgggtgttagtatcggttcgtgagattgagtgtggttcgggtggtgtaggtcgtttaggtgcgatattatggtcgtaggtggggtgtttaggtcgcgggataggtgttgtttatcgcgggttagtatggtagtgtggtgcgcgtcgaagttggggttgagtattttgtcgtggttcggcggatcgtagttgggtagattttgttgcgcgttgtggaggtcgtttagttcgttgtttagcggcgtggcggttagcggggataggttttggtttatgtcgggtatttttttgtagggattgtagaggttgtttatggtcgggagttcgcgttcgtcgcgtatgagggtgaagttgtcgttgacgttgtcggataggcgttggtggtggtggtggtggtggtggtgcggatggtggtgcgggtgagggtggtggaatttgttagatacggtggagatgggtggtagcggttggagcggtgttagcgtggtgtaggtgttgtttatgtttatgttaggcggagacgagtcgtaggatatgtttatggcgtggtgtagcgggatggagagttcgggtcggtagtcgtcgtcgtttaggatcgaggttatgttggtgattatggtcgagcgcgacgtcgtcgttgtcgtcgttgtcgtcgtgtttagtttttggtgcgcggttggaggcggcggagggtttcgtagcgagttagcggcgtcgcggttcgcgtggtgggggttggggttggttagtagtttttgtttatggttcgggttttcgtcgtcgttttcgtcgttttcgtcgtcgttttcgttattgtcgtcgtcggtcggttcgtgtaaagtgtttagattttttattgttagtttcgggtttatggcgtagttttttaggtttttggtgaggtatcgataggcggtgtaggtagtttttatttagtttattagggttcgggggcggcgggggcggcgggggcggtcggcgggcgggtaaggcgcgcgtggcggggttcggttgcgggagtgggggcgggcgcgggagtgagtggagaggagtgcgcgtgcgggtgtgcgtttcgggttgcgggcgggttcgttcggggtgggggcggggtgggggcggacggggcgtgcgtgcgggagaggggaggggacggggagggagggagggattatcgggtttcgtcgttcgggtcggttcgtagtttcgttatgttcgagttcgtttcggcgtcgacgttttttgtttgggtgagcgggagttgtttagaagggttttgtcgttcgtcggggtagttaatttattttttcggatttggggcggggttacgttcgacgggcgttaagcgtaattatttcgaggtcgtagttgtttcgggaggcgggttttttacgggaagttattagtggttgtggagggggcggggtcgtattttttaggtttggttgacggttcggtgttttttttattttttttgttattggaattaaacgttaaggagagggagggaggagaaggtgggggggtcgttggggagagggaggttggagtgcgagcgagcgagagagattcggtgaaagatgtcgtgttgtgttttttttgagtagttgcgatttgggggaaggggtattgttttaatcgttttcgttttattttaaagtttttttggaggcgagtaagtcgggagtaaaagatttcgttatgtgttagtatagataaatattcgttattaataagttatttatcgagagtttttagttgggagttaatagtttagttttttaaaatgtaggcgttaatgtattttaatgtatggtaaattttcgaggtcgggatatgtataatttacgcggttagagtaattgtagtgttttcgtcgttagcgagttgcggtcggtcggcggtttacgggcggcgcgggtagtagtaatgtatgtaaagttaatataataatattatttaattattcggtgagtttataaattttagttatgaggttttcgaagagttttgttagattgtaaaataaaattagaatttcgggagttgtcgttttaaggtgattaagtgttttttgtattagcgatttggaaagaagtggggagagtgtagaatcggtgaggtggaggtgaggagggtcgttggtgttttaagtgagtaaattttttttgggggtagagagtaagtaaattagttgagacggtaattacggattttttttttaatacgagatatatatacgcgtatatatatatatatatatatatatatatattttcgttttttttaaatttcgggagagaaacggcggtgggtagacgataaggaattttggttgatatttgtatatttaaattttgtttttgaaaagattagcgtttcggttagtttgagaacgtttataagttaaggttttaaaaatcgtatttacgtttttttagaattttcgttgtttggtaattttaggtttggaggtgggagtggaattgggggatagagagttggagatttttgtagttcgagtcggggtggaggggtagttgaagatagagaggttaatattcggtataaagttttaaacgtaataagatttttttaaagtaggttgcgttttgtttgttttcgaagatttaagttagttgaggttgcgtagatgttgtttttgtttaaagagatagtaattaaggatagggtggatataagtttgagaagcgtgatttatttttttttgattagttgttaaaagaagagtagggggtttttttaagatagttttttttaattatttttagttgttagagaaaatttgataagaaaataagggtagagttcggaatattgtatgtttttttttggtgttagagaaaggtttgatttat

SEQ ID NO: 276 - DNA, 6456 bp, Artificial Sequence
  chemically treated genomic DNA (Homo sapiens)
taaaattttttaaaattgaaaagaagaaaggggtaattggagaatttttattttttttggttgttttttttaagtcgtttagtttttatgaatagtatttagttttattgttattattaataatttttaaaattagttaatgtttcggtttttagtattggaaagttttttaaataggatattggaaatttttatttataagtttggggtggcgggcggggcggggaggtggagagagagttgttatttataggtttttattttggtttgaagatttaattgtagttattagagtaagggaatgtttattttttggtatttgttcgttattttttttttttttagagataaatattttttcgttttttttaaaaaagtatatattttaaagtaagaatgtgattttattttttttttttgagtttatgtttgttatttttaggaatagcgtgtggattagggttagatgaattttaatttgggttgtagatttacgaggttttgttttagtgttaaaggtttttggtagtaaatagtgagtaaaatagatatttgttttttgatggattttgtcgttttttttttttttttttaagttatttattaaaattatatatattttgtaaagaaaaagggaaattggtagtttttgtagaggaagtcggtggtatcgtttagagttataaattgtatttttaaatagttttttttttggtttttttttttttgttttattttttttaaaatttagattgtaaaaaatatatttattgatatttattttattttaaaaaaagaagagaaaaagtaaagcgttataagattttttttttggaaattataaattgaaaaaaaaatttataaaagattaaattttggcgggttgtggggtggcgggggtcggcggggagggggcgcggagtggagattggttttttgaggtggttaggggttttgtgatagtttgggatttttagtatttggtttggggttatttatttgtttaattgttaggattttttatttttaaattttagttattaatataattatcgtagaagggaatataatatagagggtttttttttatttttttaaaaaatcggtttggttgtgtttttgttttttatgggggagttttaaaatttattattgtaatattagttttatttttcgttagggttttaataatacggtattataaaggtaacgtaatttatagtttttaagatatttattacggttattatattcggtagcggggtggtttttagtttttgttgttttttcgtttttttttttcgttcgttttcggagtttagtcgatttttgaggttttaattttatttatttttttttcgggtcgtcgtcgtcgcgtttttttttatttttattttttcgaggagagttataggttgtaaatttaattaatttcgtaatttatttttgtaaaattatttataaagatttttttttcgcgttcgcgttcgtttttttcgcgtcgggtttttttagttacggttataaagtgtttttttttttttttgagttttgtatataaggaacgcgggttggggttttgttcgttttttttttcgtttaaggtaaggatttcgggaatttgaagtttggcgtttattacgtttaggttcgtagttttttttttatagagtttgtattatgggaaaaaataaaataaaatttaggaaagggaggtaatagttattgggagttaatatagagttacgtagcgtttaaaatataaatatcgtagcggttagaaatttcgttatttttttcgtttttttaggttgttttgtcgaggttttttgagttttttcgtatattgaaaggtatcgtaggtgtagtgcgtattttttttttatttattttaagaagttttgtttcgttattagttttttttttcgggatgagtagggagagcgcgcggaggttttcgattttttcgattataattaagaaagaataatttttaaagtgtttaatattttcgtttttaagttttttaaaatataggggtagggaatattaaaatattcggtttttattaggaagattacggttttgaaaggaaatagtagatacgatattttattttatttggatttatgattaaaaaaataaaaataaaaatttaaagagttcgtttgtattttttttttttaaatttcggttcggttcgaaggtagggaatttaaaagatcgaggtcgatggaagagagttagcggggcgagcgagcgggtagtttttttttttgtttttcggagttatttagaaggataggggaagggaaggaagaagaggcgaggaaaaagaggagggagggaagcggaggttaggagcgacggagtaaggaaagtagtttgtaagcgagaaaagagggaaaaaatatagtcgtacgaatttagagagattataagtcgtacgtaagtagtagtagaaagagcgagagcgcgagcgcgcgtttttttcgcggtttggggttagatagtttttagattagttcgaattattttttaagtattgtttcgttttttttgtttcggtcgttttttaatttttttttttttttttttttattttttttttaaaaattaaaataatataagggagggtggtaaaagtttttttaaatcggtcgatttatttaaagataataataataataataaatatataataatttatattttatggtgggagagacgtgggattaattttcggtatttattttaatatttgatagttagaataaataaatatatatatttatattaatagatatatatagaaaatttggagttaaagtatttggtaagagcggaaaaaaaaagaattaaaaggtaaaataatgattatgagtagcggcggcggtagcggtattagcggtaatagcggcggcggcggtagtagtagtagtagcggcggtagtaatagtaataattatttggtgttcggttttttttagaaattttttgtattattatttttaagaattttagttttaagaattaatagagtttaattttcggaatttgagtttcggattttattattgttacgtggtaggggaggatttggtgttagtttttcgagatttttattgtttttggttaattaaaagtttttaaagttataagatttttttattggtcggtatatttcgaggtttttataagtagagcgtttcggatttggaggtttcggttcgaggttcgaggggtttgaaggtggtttttttttttcgggtttaagacgatggtatggtttgtttcgttattattacgtgggttttttttttgtgacgtcggcgttttcgttgtagtaaagttcggtttttggaattttgagaattaatttgttattcggtgatataagagggggagtgcgttttgttttttcggggtttggggttaatttttttttttttatttataaatttagtagatcgagttaaatgtataaaagggagcgagaggtttgaattattgggaaaagtatgttatatatatagtagggttagagaggcgagtaagagaaaaataaaataaaataaatattatagttttttttaattagaatattaggtattacgagaaaaatatttgttaagtagttttcggtgggtttatttgttttatttttatttaggataggggtttttgttgttgttttgggtttttttttttttggtgtggtggtttgggatttttggtttttgtattttgatggtttatggatttttgtttttgattttttgttttttgtaagtttgtggtgttacgtaaattataggatcggtatcggttggatttttttgtacgtgttttttttttttttatttaattttttaagcgttttaaagatgtattattttaatattaatattattgaaagaagtttaaatttttggttatatgtaataattttagtttttatttttttttttttttttttttttggtgtaatttttttttttttttttggatttttgttgaagtgtgttttttttgtattttagagaaatgtttaaaggatttgttttggtttggtttgtttttttttaggatagtaagtggtgggtttaatttgttattgttgatttttgggaaattttttgttgtaagaaacgtgtgtgtgggggggagggtgggggtggcggggtggtatgtgtgtgttttttataaaattttgtgagttaaatatttgtttgtgttttgtttttttttaaggttttgagatttttgttttcgaggttcgttttaaggtcgttgtaaaaaaatttttttagtttgtgtttaagagattagtcggagggaattttaaaggtttgtcgtgttagtattatagatattgtttgtatttagaatagattgttataattataatgtattatacgtagtatagtttttttagttttgaagttgagttggggggtggggtggggggggggtagagaagaaggagaaattttttttttttttttttttttattattttttttttaaaggtaattgtagtgtagaattattttattgtgggttttagtttgtttgtttagagttgttagtttttttatttaaatgttggttcgggttttttttttttttatttatttttgaataagggagatttttgttttttttatgttttttttttaaaagaagggtgtgaggggaaaataatattttagattttttaagaattagtttaaaatgtttggattagaagtagtttttaaaggttaggttgttttgagttttggttatgagagttttttaagcgatttattaaattatagatgaatttttaaagtttttataaaatttcgttatttgttaatttttaataaagatatgtttaaaataatttatttattttaatttaaaatttgggtttataatggaggagtgattagagttgtgaaagattgttgtttgttgggatatttggaaaattttttttattgatagtttcgtaagaagttttatttattatcgaaaatgttgttggtaatgtatttttttattttataatatatatatatttttaaaggttgtattttaggttttaaaatttagaaaggtgtaaagaggttgattattttttataagggttggagtttaggaaatatgcgttaaagtgtttgtttttgtgaaatttgaatattttaatatttattgatagatggattattgtagtttttgtagaaaagtttgttttgtgaacggtttttgaaaaatatatataggtttaattttgttattgttgttgaaatgtacgttttatttttaaagatatatgatattgttaagtttagatttattttgttagaaggtagattatttgtttttttatttgagttttttttttttttatttttaaagaaattaaaatgaatttcgttggatgtaaaatgatatttcgattttgtggaagggattttttttgtgtgtttatatgtgtaatttttttttttatgagtaattagtattttaggattttttagacgtatttatatggtttggaatgtgaattgtatggttttgttttattattgggtttttaaaagattatttttatgatttttggttatttttttttttgttaaaattgttatttagttttatttatcgttttttttaatttgaaatatagtttgttttttttgtgttttttttgttattttatttttagttttatgggggcgttgtagagtaaagggaaatttgttttttaaggtagtagtagaattagttagagtgggggttgggaaggaatttattttttttatattttagttttttttaattttttgtagtgagtttttagagggagaatttattagggttggtttatatataattaattttattattagggattttaaatttttttagtatattatttttgggattaagtgttagagtgttatatttttttattgttttttgttaaattaatgtgtttatattgaaagaaattgattagaatagaagattagttagaaagaaagagaaaattattattgaaaattttttaaagataggtatttatttttcggtgagttttttttattttgaattgaatgaatggtgaggaaaattgtgtattcgttttttaatttttttttaatttttaggaaagtaattttgttaaatattatattagttgaattttttttagaatgttatttttttttttatttttgatttttttttagtatttagttggtattattatgtgggttttttttattttcgtagtgtcgtgttataggattaaagaaagggttgatttgaacgtattttgatttttttaaattatttttaagaagttttaaagagtgattttatgtttggggtcgtatgaataatttttgtagatttcggggtattatattttaattagttttatgatttaatggttattgg

SEQ ID NO: 277 - DNA, 6456 bp, Artificial Sequence
  chemically treated genomic DNA (Homo sapiens)
ttagtaattattaaattatgggattagttgaaatgtagtgtttcgaagtttgtaggaattatttatacgattttagatatggaattattttttagagttttttaaggatgatttaaaagaattagaatacgtttaagttagttttttttttaattttgtaatacggtattgcgggagtgagggaggtttatatagtgatgttaattggatattgaggagaggttaagaatgaaagaagaaatgatattttggaagaaatttaattggtataatatttgataaagttatttttttaggaattgaaaagagattgagaggcgggtgtataattttttttattatttatttagtttaaagtaaaagagatttatcgaaaagtaagtgtttatttttagaaaatttttaataatgattttttttttttttttaattggttttttgttttggttaattttttttagtgtaaatatattgatttggtaaaaagtagtaggaaaatgtggtattttggtatttggttttagaaataatatgttgggaagatttgaggtttttggtgatgaggttaattatatatgaattagttttggtgggttttttttttaggggtttattgtagagaattaaagagggttgaggtatgagaagggtgaatttttttttagtttttattttggttggttttattattgttttagagagtagatttttttttgttttgtagcgtttttatggggttaagagtggagtggtaaagggaatataggagggataagttgtgttttaggttgaggggggcggtggatgaggttgaatggtagttttgataaagaaaaaagtgattaaaaattataaaaataattttttgagggtttaatagtaaggtagagttatataatttatattttaaattatatagatacgtttgagaaattttaaagtgttaattgtttataaaagaaaaaattatatatataaatatataaagaaaattttttttataaaatcggggtgttattttgtatttagcgggatttattttaatttttttgaaaatgagaaggaaggggatttaaatgaaaaagtagatagtttgttttttggtagaataaatttgaatttgataatattatgtgtttttgggggtaaaacgtatattttaataatagtgataggattaggtttatgtatattttttaaaaatcgtttataagataggtttttttgtagaggttgtagtaatttatttgttaataagtattaaaatatttagattttatagggatagatattttaacgtatattttttaagttttagtttttgtggaaaataattaatttttttgtatttttttgggttttaaaatttaaaatatagtttttaaaaatgtgtgtgtgttgtggggtaggggggtgtattgttaataatattttcggtgatagatggaattttttacgggattgttaatgaaagagattttttaaatattttagtaaatagtaattttttatagttttgattatttttttattataaatttaaattttgggttgagataggtagattattttagatatatttttattagaaattaataagtgacgagattttgtggaagttttaagaatttatttgtaatttaataagtcgtttgaaggatttttatagttaaggtttagaatagtttgatttttgaaagttgtttttggtttaaatattttgggttaatttttgaggaatttgaaatattattttttttttatattttttttttaagagagagatataaaagaaataagagttttttttatttagggatgagtaggaggggaaaaaattcgaattaatatttaaataaggaaattagtagttttgaataaataaattaggatttataatgaaatgattttgtattgtaattgtttttaaaaagaaagtaatagagaaaaagagaaggaaagaattttttttttttttttattttttttttattttattttttaatttagttttaaagttaagaagattgtgttgcgtgtagtgtattgtagttgtggtagtttgttttaaatataggtagtatttgtgatattggtacggtaggtttttagaatttttttcggttgattttttaaatatagattgaagagatttttttataacgattttgaaacgagtttcgaaaataaaaattttaagattttaagagaaaataaaatataaataggtatttggtttatagaattttgtagaaaatatatatatattatttcgttatttttatttttttttttatatatacgttttttgtaataagaaattttttaagagttaataataatagattaaatttattatttgttgttttggaaagaaataaattaaattaaaataaattttttgaatatttttttgaagtgtaggagagatatattttagtaaaagtttaagggggaaaaagaaaattgtattaaaggaaaaaaaaaaaaaaaaagtgggggttgggattgttatatatggttaaaaatttaagttttttttaatagtattagtattgaaataatatatttttaaaacgtttgagggattagatagggaaagaaaaggtacgtataaaaaaatttaatcgatgtcgattttgtgatttacgtaatattataaatttgtaaaaggtaaaaaattagaagtaaaaatttataaattattaaaatatagaaattaaaaattttaagttattatattagaaagaaaaaaatttagaataatagtaaaaatttttgttttaaataaaaataaagtaaatgaatttatcgaaaattgtttggtaaatatttttttcgtggtgtttaatattttagttggaaagagttgtgatgtttattttattttattttttttttattcgtttttttaattttattatatatataatatattttttttagtggtttaaatttttcgtttttttttgtgtatttagttcgatttgttgagtttatgggtaagaaagaaggaattagttttagatttcgggaaagtaaagcgtatttttttttttatgttatcgaatagtaaattagtttttagaattttagaggtcgagttttgttatagcgaaggcgtcgacgttatagaggaggagtttacgtgatggtggcggagtaggttatattatcgttttgggttcggggagggagagttatttttaggtttttcgagtttcgaatcggaatttttaaattcgagacgttttgtttatgaggatttcgaaatatgtcggttagtgaaaaaattttgtggttttgagggtttttggttggttaggggtagtaaaaatttcggagagttgatattaagtttttttttgttacgtagtagtggtaaagttcgaagtttaaatttcgagaattgagttttgttgatttttagaattggggtttttagaagtggtgatgtaagaagtttttaggaaaggtcggatattaggtgattattgttgttgttgtcgtcgttgttgttgttattgtcgtcgtcgtcgttgttgtcgttggtgtcgttgtcgtcgtcgttgtttatgattattattttattttttaatttttttttttttcgtttttgttaaatgttttggttttaagttttttatgtgtatttattgatataaatgtatatatttatttattttagttgttaggtgttaaaataaatgtcgaagattagttttacgttttttttattataggatatagattgttatgtatttattattattattgttgtttttgagtgaatcggtcggtttggggaggtttttgttatttttttttgtgttgttttggtttttggaaaggaggtggaggagaggaaggaggggaattagggggcggtcggagtagagaggacgagatagtgtttggggggtgattcgggttagtttgggggttgtttggttttagatcgcggagaggacgcgcgttcgcgttttcgttttttttgttgttgtttgcgtacggtttgtgatttttttggattcgtgcggttgtgtttttttttttttttttcgtttgtaaattgttttttttgtttcgtcgtttttggttttcgtttttttttttttttttttttttcgtttttttttttttttttttttttgtttttttgggtaatttcgggaggtaaaaagggaggttgttcgttcgttcgtttcgttggtttttttttatcggtttcggttttttagattttttgttttcgagtcgaatcgagatttggaaggaaaaaatgtaagcgaattttttgggtttttgtttttgtttttttggttataaatttagatgagatgaagtatcgtgtttattatttttttttagagtcgtgatttttttaatgagagtcgagtgttttggtgttttttgtttttgtgttttggggagtttgggggcggggatgttgaatattttgaaaattatttttttttggttgtagtcgagggagtcgggaattttcgcgcgttttttttgtttatttcgaggagagagattgatggcgggatagggttttttggggtgggtgggaaaggggtgcgtattgtatttgcgatgttttttagtgtgcggggggatttagggaatttcgataggatagtttgggagaacgagaaaggtggcgggatttttggtcgttgcggtgtttgtattttgggcgttgcgtgattttgtgttggtttttaatggttgttgttttttttttttaaattttattttatttttttttatggtgtaagttttgtaaaaagggaattgcgggtttgagcgtagtggacgttaggttttagattttcgaggtttttattttgggcgaggagaaagacgaatagagttttagttcgcgttttttatgtgtaagatttaggaggagagaagggtattttgtggtcgtggttgaggggattcggcgcgggaggagcgggcgcgggcgcgaaagggagatttttgtgagtgattttgtaaaaatagattgcgaggttggttggatttgtaatttgtggtttttttcgagggagtaagaatgggggaaggcgcggcggcggcggttcggggagggagtgggtagagttggagttttagaaatcggttgagtttcgggggcgggcggggagaaagggcgggggggtagtaggagttaggggttatttcgttgtcggatgtagtgatcgtggtaaatgttttgagaattgtgggttgcgttgtttttatgatgtcgtgttattggaattttggcgaaaaatggaattagtgttgtaataatgagttttaaagtttttttatggaaaataaaaatataattaaatcgattttttaaaaaaatgaaaaaagattttttgtgttgtgtttttttttacgatggttgtgttggtggttggggtttgggggtggggggttttgatagttgagtagataaatgattttaaattaggtgttgaaagttttaagttgttatagggtttttgattattttagagagttaatttttatttcgcgtttttttttcgtcggttttcgttattttataattcgttaggatttaattttttatggattttttttttagtttatagtttttaggaggaaagttttgtaacgttttatttttttttttttttttttaaagtaaagtgagtgttagtagatgtgttttttatagtttggattttaaaaaaagtggggtaggagagagggaattagggaaagggttgtttagaaatatagtttgtggttttgagcgatgttatcggttttttttatagagattgttagtttttttttttttttgtaaggtgtgtgtggttttaataaataatttaaaaaaaaaaagagggggcggtaagatttattaggagataggtatttattttgtttattatttattattaagagtttttggtattagaatagaatttcgtaaatttgtagtttaagttgaagtttatttggttttagtttatacgttatttttggaggtagtaaatatgagtttaaagaagagagatgaaattatatttttgttttaaaatatatatttttttaaaaaagacgaaaagatatttgtttttgggggaggaggaaatggcgaataagtattaggagatgggtatttttttattttaatgattgtagttgagtttttaggttaaaatagaaatttgtagatggtaattttttttttattttttcgtttcgttcgttattttaagtttataaatagaagtttttagtattttatttggaagattttttaatattagaggtcgaagtattggttagttttaagggttgttgatagtgatagtaaggttagatgttgtttataaaaattgggcgatttgaaggagatagttagaaaaagtgggaattttttaattgttttttttttttttttagttttgaagggtttta

SEQ ID NO: 278 - DNA, 4001 bp, Artificial Sequence
  chemically treated genomic DNA (Homo sapiens)
tgtatttttttttttttttagtttttattaatttttgaaaaaaaatttttttaattagaaattttgtgagattgttttttttttagttttgattttaatgtttaagaaagatggtattattttttttgattatgaaaatttagatttttattattttttagaaatgtgatgagtgtgaagattattttgaatatttttaagttattagtttagttttttttttatggattatagtattgattttgttaattgataaaaataattagaaaatgttttaacgatatggtataaattatgaatattagaatttattagttttttttttataatttttttttattaatatgtaattgtaaaagaagaataagaagggaatgggggtaatggatttaggtttaaaatatatattttatttttgtttttttttatggttttttttggtatgtatgttgtatatttttaatatttttaagatattaaaaatttattaatttaagtatatttaatttagatttagttttagtttagatataatgtttgatttttaagagtttaaaatataattaaaaatgtaaatatttgaaattagtgttatattgagagttttttaaaatttaaatattaagatatatattttttttattaagatttgatttttaatatatattttttaaggtaattaaagggaatatttatttttgtttgaggaaaaaatattttgtaagttaaaatttttattaatatagtattttattatatgattttttttttttattttaaaataatggggtttaattttttgaagcgtagtttttttagtaataaaggcggataaatttgtttttttttgtaagtagatattttttaaaggtaagaaagggaagattttgttagtttagtttattatagttaatgttttttttattaagtgtttaattgtttcgaaagttagatgttttagaaagttagatgttttatagttgttttggtggtaattattttaagatagcggtattaaaggttttgatttttagtttttttatttaaaaaatggggatattaattattttataataaagttttgatgatataatgagattataaataaaatattttgtgatgtttgatttattatttaattaaaatttttataatggatttatatttttggtttagttattatatattttgttaagtggtttttttttaagaaaaattggggatgggggggttaggggggtgggagagtagtagggagtaggaggtagggaaggaggaaaataagtaaaattagtatatatataagtttttttatttttgattgtttgcgttttttgtgttttttttttttaagtttttttaggtttatgttttgaatttttttttttataaatgaaatataacggatacgaattatagagaattttacggaagatattggagtttaagtttgtagattagttttttgtttataagcggaggcgattggaaaattaagttaaataagcgttggataattttaaatagttaaagaagttttaatgggatagggtttaggtttattaaaggaggtaatattagtaattgacgaaattatagcgacggttgatcgattatgattcgaggtataagacgttaaatttaaggttattaattaacgtgcgtaagaagcggttttaatcgattcgggcgatgttaatcgcgtaattattggtcgtcgcgttattttaggtttaggaatagtttagttcgtaatagggagattttaattagggagaggaggagcggggtaaaggggttgggtgttttttaagtcgttgcgcgggacgtggaagggacgaaagaggtgaggaagagtagtaaattaatttaatatatttatatttttgttgtgtttttaggattacgagaagcgggtagggggcgattttcggttttttttatttcgtaaaggtttttaattgggtttttcggttaattttttagttatcgttattttgaaatttcgcgttttttcgtattttttacgttattttttatttttttgtttcgtttttttttagcgtcgtttgattttggaattatagagaatatttaagaattttaggattagagtttttttcggttttatataatatttaattggttggttgtcggttaagagttcgttttattgcgtttatttagtataataggaattagaagaagatagttgttaattgagtggttgacggttttgtttttcgagttggaggtattttgatttagttgttgggagtttggtacgttgagtcgttcgagaacggtatattttgtagataaagaagcgttttgcgttttttgttttttggaattattttagtttttgtatttttttgttttttatgatttaagtaggtgcgattttttaggggtgttttcgtgtgtaaacgaatatttagataatatttgttattgagtttaattcgttttgtaagtattaggttattttatgtgagcgtttagtacgtgtggaaatttaatagataggtagaatagaacgtttgtagattatttgaataaataaattagtattcgtattagagtcgtagattgtttatatgggcggtgatttattatttgttagtagtgttttgaagaagaaatacggggatatatatgtagtcggttttaagttatatgagtggtaaggttgatatatattggttatattttcgattggtttttttattagttaaaagttttttatgatgttattttacgtacgggattttttatttaattttagttttcgttttttttttattttttatttttttttttcgtgagttagtttttatttattttttttaaaggtaagtttaaatatttaaaaaattattttagaggatacgtttggttatttttaattttaatttgattattttatgtaggaaggttatttttattattagttataaatattttaaaatattgatggagatatatattaatttttagtagaatttttaaattgtttttgaaggtataagatcggttttatatttaaatttatttttgtgttaggaaatttttgatttgattttagattgaatttgagtgttagaaagtaatgacgagatattgtaggttaaagttgataaattaggtagtatataaaaaagaaaataattttgaattgcgaaggtgagttaagttgtaatgttttgtaattagtttttttttttttttaatatattagtgattatagttttgtaattcgttttgaaaaataatgtaagaagagaaagagaaaatagtgtatgttggaaatattaaagttttttatgtagttaaaattttatatgtagttattatttttaagatatgttgagtagtttttattttaatatattttttgtatttggatgggagaattaattataataaatatagtttggtattaatagtatattaataattttgttagtatagattaaaagagtttttatgggaattattggttggtaaaggatttagaaaataaatatatttgtagagatttagcggaattattaataggtttttatagtttttggcgttttttaaaattaggtaattagtgaaatggtttatttaatgcgttatgtagtaaaggtagttgttttttttttgttagtgttgaaaatgaaattatatttttttttttgaaagtttataataaattatgatttttttttaaatgataaatgttttgagtagtgattttttattttgtattttaaatgtaatatgtgtagttgtgttttgtttttttgttttttaaatgttttagtgtttgaatatttatttgagcgatatttaattattatagttggttagggttgattgtagtgattgaaataggattttgatgtttttagttttgatttttattatttttaaatttattcggtttatattgtgtaattagtagacgtttatagattagttttttgttttaattgaagtatattgttata

SEQ ID NO: 279 - DNA, 4001 bp, Artificial Sequence
  chemically treated genomic DNA (Homo sapiens)
tgtaataatgtgttttaattaggataggaagttgatttgtaaacgtttattgattatataatgtaaatcggatggatttgaaaatggtaaaaattaaaattaaaaatattaaggttttgttttagttattgtaattaattttgattaattgtgataattaaatatcgtttaagtgaatgtttaaatattgaaatatttagaagataagaaagtaaaatatagttatatatattgtatttaggatgtagaatagaaggttattatttaaagtatttgttatttaaaagaaagttataatttattataagtttttagaaaaaagaatataattttatttttaatattagtaaaaaggaggtagttgtttttgttatatgacgtattaggtgggttattttattaattatttgattttagaaaacgttaaaggttatggaagtttattaatggtttcgttgaatttttgtagatgtgtttgttttttaaattttttgttaattaataatttttatgaggatttttttagtttatattgataaaattattaatatgttgttgatgttagattgtgtttgttatagttgatttttttatttaagtataagaaatgtattgaaataaaaattgtttagtatattttaaaaatagtagttatatataaaattttagttatatgaaagattttaatatttttaatatatattgttttttttttttttttttgtattgttttttaaaacgagttgtaaaattatgattattaatgtgttaggaaagaaaaaaaattagttgtaaaatattataatttagtttattttcgtagtttaagattatttttttttttatgtattatttggtttattagttttaatttataatatttcgttattgttttttgatatttaaatttagtttaaaattaaattaagaattttttaatataaaggtaagtttaggtataggatcgattttatatttttaagggtagtttaaagattttgttaaaaattagtatgtatttttattaatattttgaaatatttataattggtggtaagaatagtttttttatatgggatagttaggttaagattagaaataattaagcgtattttttaagatagttttttaaatgtttaaatttatttttaagggaaataagtgggggttgatttacggaaagaggggatagaaggtagggaaagggcgaaggttagagttaagtgaagaatttcgtacgtagagtgatattatagaggatttttggttggtgaaaagattagtcgggaatatagttaatatatattaattttgttatttatataatttaaaatcgattgtatatgtattttcgtattttttttttaaaatattattaataaataataaattatcgtttatataagtaatttgcgattttaatacgggtgttaatttatttgtttaggtggtttataaacgttttgttttgtttgtttattaaatttttatacgtattaggcgtttatatgggataatttgatgtttataaagcggattaaatttagtggtaaatgttatttgggtattcgtttatatacggagatatttttaaaggatcgtatttgtttgggttataagaaatagaaaaatgtaaaaattaaggtaattttaaaagatagaaaacgtagaacgtttttttatttgtagaatgtatcgttttcggacggtttaacgtattaggtttttagtaattaagttaagatgtttttaattcgagagataggatcgttagttatttagttagtagttatttttttttaatttttattgtattagatgagcgtaatgaggcgggtttttagtcgataattaattaattgagtattgtatggaatcggaagagattttggttttggaatttttgggtattttttatggttttagggttaagcggcgttaagagaaggcgggatagaggaatgggaaatgacgtgaggagtgcggaggggcgcgaggttttaagatggcggtagttgaggggttgatcgagagatttagttgaaggtttttacgaagtgaaagaggtcgggagtcgttttttattcgtttttcgtagttttgggagtatagtagaagtgtgagtgtattgaattgatttattatttttttttatttttttcgttttttttacgtttcgcgtagcggtttgggggatatttagtttttttgtttcgttttttttttttttggttgaggtttttttgttgcggattgggttatttttgggtttggggtggcgcggcgattagtggttgcgcggttggtatcgttcgggtcggttggggtcgttttttacgtacgttgattagtagttttaggtttgacgttttgtatttcgagttatggtcggttagtcgtcgttatggtttcgttagttgttggtgttgttttttttggtgaatttggattttattttattgaagtttttttggttgtttagagttatttaacgtttatttggtttgattttttagtcgttttcgtttgtagataaaaaattaatttgtagatttaagttttagtgtttttcgtaaaattttttgtaattcgtattcgttgtgttttatttgtgggggaggagatttagaatatgagtttgaggaaatttgagaaaggaaagtataaaaaacgtaggtaattaaagatgggagagtttgtatatgtattgattttgtttgtttttttttttttttattttttattttttgttgtttttttatttttttaatttttttatttttagttttttttagaaggaaattatttgatagggtgtatggtagttaggttaggaatatggatttattataaagattttagttaagtagtgagttaaatattataggatattttatttgtaattttattgtattattagagttttgttataaagtaattgatgtttttattttttagatgaggaagttaaaaattagagtttttgatatcgttgttttgaagtaattgttattagaatagttgtgaaatatttggttttttgaaatatttggttttcggggtagttggatatttggtgaaagagatattaattgtaataaattgggttgataaaatttttttttttttatttttaaaaagtgtttatttgtaaaaggaagtaaatttgttcgtttttattattggaaagattgcgttttaaaaaattaagttttattattttggaataagaggaagaagttatgtaatagggtattgtgttaataaaagttttagtttataaaatattttttttttaaataaaaataagtattttttttaattattttaagaaatatatattgggagttaggttttagtaagaaaaatatgtgttttaatatttaagttttggggagtttttagtatagtattaattttaaatatttgtatttttagttgtgttttgaatttttgagagttaagtattatatttgaattagaattgaatttgaattaaatatgtttaaattaatgagtttttagtgttttagaagtattgagaatgtatagtatatatgttaagaaaaattatggagagaggtaaaggtgaggtatgtgttttgagtttagatttattatttttattttttttttattttttttttataattatatgttaataaagggaggttatagaagaaggattaatgaattttgatgtttatggtttgtgttatatcgttaaagtattttttagttgtttttattagttgataaagttagtgttgtgatttataagaaaaaagttaaattgatgatttgaggatatttaaagtggtttttatatttattatatttttgaagaatgatagagatttaaatttttatggttaagaaaggtgatgttattttttttggatattaaagttaaaattaaggaaagaatagttttatagaatttttaattaaaggaatttttttttagagattggtagggattagaaaaaggaagaaatata

SEQ ID NO: 280 - DNA, 4341 bp, Artificial Sequence
  chemically treated genomic DNA (Homo sapiens)
ttatggaagtttttagcgggggtttgtaagggattgtgagttgagttaaggagaatggaggtggggtgttaatcgtttttaaagggaaatgttattttttatttatagttagttagtcgagaatgggagtttttaaagggaggattatttatgggtttgtttgatttagttttttttaattttttttatttttgtagtaaaattttagttaaggaagataaagagatttttggagattaaaatagaatttttaattcgggttaatagtaggtttatgtttaaaatggttgttaattttaataaagaaagtagttagtttatatgtcgtttgagatgggaaaaataaggtaggatataggttttagataaagatagtaaattatttaattcgtgataattttgaggaaattggtaatttagttatattgattagttattttttaagttggattagggttggaggttggggtttcgaggtaggtgataagtttttgagataagtttgtatttgtaatttgttataatgttgggaggggttgtttaaaattttagtttatgtgttatttttaaatagtttatattaaatgttaattgtttttatgtgcgtttatgtgaagagattattaaataggttttgtgtgagtaatatggttgtgtattttatttgggtgtaggcgggttgagttcgaaaagagagttagcgaagggagataggggtggggtcgttttataggatttgggaaggtaatggaaaattatagttaaagggggttgttttttggtgggtaggggtgaattttataaagtatatttttaagggtggggagaattataaataatttttttaagggtggggaagattataaagtatattgattagttagggtggggtaggaataaattataatggtggaatgttattagttaaggttgtttttattttttttgtggatttttagttattttaggttatttggatgtatatttgtaagttataggggatgcgatggtttggtttgggatgcgatggtttggtttgataattattatttatgttatgtttattattttaagttttattattattattttatttattttattttattttttttttatatattcgtttttattttggagaggttagatgagttagattttagggaggtttagaagtgggtaaggggaaacgggaaaggaggaagatggtatgggtgtgtttggttaggggtgggagtgttggacggagttcgggataagaggggttttgtagttattggtatataatgtttgggagtttttgttggtgttgggattattttagtgagttttgggagggaattgaagatttttaattattaatgtatttgtttttaaaatcgacggggggaaggatatgtttaggtttaaggatacgtgtaggtttggatgatttcgggttattagggagttttcggagtattttgatttttagacgggtttgatgaaacgagtatttgatttagtaggtttgggttcgggttcgagaatttgcgtttttcgcgagttttcgcgaggtaagtgttgtaggtgcggggttaggagttaggtttcgtttttgcgttcggagtcgtttttagtatagggtttgtgagttttattttttcgcggcgcggggcggggttgggcgcggggtgaaagaggcgaagcgagagcggaggtcgtattttagtattgcgtagggatcggtgagtgtcgtttttgggggtagcgtttagtaatcgcgttaggagcgcggagaagggtattgggagagcggcgttcgtggcggagattagcgtttcggagtacgggtacgacgggggtattttttcggttgttagtaattaataataataataattataattatagtaagggcgttgatgggcgggttcggagtacgtttgattttggtttttattaggttgtttaggtttttgatgacgtattagaaatatttttttaattcgcggtttttttgtaggagaggttgggaaggggtgggggacggggttcgggggaggttttcgagggattttagtaagcggggaagggcgtcgggaaagttttagatttacggttgcgcgggttacgagtttattcgaacgtcgattattgtttttcgtcgatttttattttttgggaacgcgcgaaagtaaatttaagttagattgcggaggtcgttggggagggaaggtttaaggagttttcgtcgattttgttgaataaagggggtttcgagttgggtcgagatggggtatgcgcgggaagatttttgttcgttgtttttttttatcgttttagtggatgttatgtttggggttttttcggcgcgtggggttgacgtattttcggggtttatcgtagttggtcgggatcgtggagtgggtgcggtggacgaagggaggtaggatagtttcgggggtggtagaaggagttcgggtatagttgagatttgcgtttttattttattaatatttatagtaggtgttgtcgagttgggtaattgggatggtttaagttatttggttaaattttaaattacgtttgttattgggaagtagagtttagtgatgttaatcgcgtttttatttttattatcggtgttagttttaaagggtttttaaaatggttgtgttattttttagttttggatcgtagttgtcggttaggaattttagtgttacggtggatacgtttttttcgcgtttttgtcgtttatttgtttatttagtttaggggttttggtaggtagtagtgtatttggtttaaagggtaagatgtttttttttttatttataataaatttaaatattagtagggtttggggggaaaaacgtttttagaagaaaaggtgaatgttagttttgtaagagttagttttaaaattagattgaattggtatatgtatatttatgtaataaatttgtacgttttgtatatgtattttagaatttaaaagtttataaaaaaagaaaaaattagattggattatgttgggaaagtgtagttttttttattttaggtattttttagaacgtaggtagtaggtggtttttattaggagttttgggagaggaagggggttgaattttattttttatttttgtttttttatggggtttgagttgaggaagttttattataaggagagaattttttgataattttggatgttatttttatttttattgtaggaattttgtggttatattgcgaggagatcggttttgggtcggaggttataggaagatttttattttttgaaatttggagtgaagaacgtcgttatttagttattattttaaggtaaggtagaaatgaagtgggtcgttgggttttttttttttttttttttttttttttgagataaggttttattttgtcgtttaggttggagtgtagtggcgttattttagtttattgtaattttcgttttttaggtttaagcgattttggtgttttagttttttgagtagttgggattataggtatatattattatatttggttaatttgtatgtgtttagtagagatagtattttattatattggttaggttggttttaaatttttggttttaaatgatttattcgttttggttttttaaagtattgggattataggtacgagttattgtatttagttaggtttattttagttgttatgttaattaggttttttgtatttgtgcgttaatttttatttttttaaaaggttttagggtgatttagtaggtaatgagtgatttttaaatttaggatttattgtgagagatttatatatataattgagtagatatttatagtataatgattaaagggagtgatagggtaaggatttatagtggaggttttggaggttagtttattgatagttattttagggagtttagaagtttcgttttagtgttgggtggtggagggaaatttgtttttttagggatttcgttttcggttgtttagttgttaaagttaggaataagtttttagaaattttattgttaagatttcgaaaacgttttagatattgttagttttttgtcgtttttgcgattttttataggtgtgcgtgttattgggtttttatttattggggtttttggtggtattgggttatagtaagtgtttttttatttttttagtttattatatatatgtttattattttgaagaaaaatttttttattatgagcgaaagtgagaaatacgtatgtttattgtttttaaagaaagaaatttaatatgggtttaatgttatttagtgagtgtttttattttgagatattagggttataagttattattatatattatgggt

SEQ ID NO: 281 - DNA, 4341 bp, Artificial Sequence
  chemically treated genomic DNA (Homo sapiens)
gtttatgatatataataatgatttgtgattttaatgttttaaaatggaggtatttattaggtagtattaagtttatattaagtttttttttttagaaataataaatatacgtgttttttattttcgtttatagtaaaggggtttttttttaaagtggtaagtatgtgtgtggtagattaaggggatgagggaatatttgttgtggtttaatgttattagagattttagtgaataaggatttagtggtacgtatatttgtggaggatcgtaaaagcgataagggattagtaatgtttgaagcgttttcggaattttggtagtgagatttttgaaagtttatttttgattttggtagttgggtagtcgaggacgaggtttttggaggaatagatttttttttattatttagtattagagcgggatttttggattttttggagtggttgttagtgggttggtttttagagtttttattgtgggtttttattttattattttttttaattattgtattgtgaatgtttgtttaattgtgtgtgtgaattttttataataaattttgaatttgagaattatttattgtttgttgggttattttgaaattttttgggaaagtgaaagttagcgtataggtgtaggaaatttggttaatataataattaaaatgaatttgattgggtgtagtggttcgtgtttgtaattttagtattttgggaagttaaggcgggtggattatttgaggttaggagtttgaaattagtttggttaatatggtgaaatgttgtttttattaaatatatataaattagttaggtgtggtgatgtgtgtttgtaattttagttatttaggagattgaggtattagaatcgtttgaatttgggaggcgggggttgtagtgagttgagatggcgttattgtattttagtttgggcgatagagtgagattttgttttaaaaaaaagaaagaaagaaaagaaagaatttaacggtttattttatttttgttttattttggaatggtggttggatggcggcgttttttattttagattttagggagtgggagtttttttgtagttttcgatttagaatcgattttttcgtagtgtggttatagaatttttgtagtgagggtaaaggtggtatttagggttgttagggggttttttttttgtggtgaagtttttttagtttagattttatagaggagtagggatgggaggtaggatttagtttttttttttttttaaaatttttaataaggattatttattgtttacgttttaggaaatgtttaagatggaagaggttatatttttttaatataatttagtttagttttttttttttttataagtttttaagttttggggtatatgtgtagaacgtgtaggtttgttatataggtatatatgtgttaatttagtttagttttaaaattaatttttgtaggattgatatttatttttttttttgaaagcgtttttttttttaaattttgttggtatttaaatttgttatgaataaaagagagaatattttgttttttagattaaatgtattgttatttattaaagtttttgagttgggtgagtaggtgggcggtaagggcgcgagggaggcgtgtttatcgtgatattgggatttttggtcggtaattgcggtttaaggttgaaagatgatatagttattttaggagttttttgggattgatatcggtggtggaggtagaggcgcggttagtattattggattttattttttagtaataaacgtgatttaaaatttaattaaataatttgggttattttaattgtttagttcggtagtatttgttgtgagtgttggtgggatgggagcgtaggttttagttgtgttcgggttttttttgttattttcgggattgttttgttttttttcgtttatcgtatttattttacgatttcggttaattacgatggatttcgagggtgcgttagttttacgcgtcggggaggttttaggtatggtatttattggggcggtgggggggaatagcgggtaggggttttttcgcgtatgttttatttcggtttagttcggaattttttttatttagtaggatcggcgagaattttttgaattttttttttttagcgattttcgtagtttgatttgggtttgttttcgcgcgtttttaggaaatagaagtcgacggaaagtagtggtcggcgttcgggtgggttcgtggttcgcgtagtcgtggatttgaaattttttcggcgttttttttcgtttattagagtttttcggagatttttttcgagtttcgttttttatttttttttaattttttttgtaggaaggtcgcgggttagggggatgtttttgatgcgttattaggagtttgggtagtttggtgggaattagaattaggcgtgtttcgagttcgtttattagcgtttttgttatgattatgattattattattgttagttattagtagtcgagaaggtgttttcgtcgtgttcgtgtttcggagcgttagttttcgttacgaacgtcgtttttttaatgttttttttcgcgtttttagcgcggttattgggcgttgtttttagaagcgatatttatcggtttttgcgtagtgttggagtgcggttttcgttttcgtttcgttttttttatttcgcgtttagtttcgtttcgcgtcgcgaagaaatgaaatttatagattttgtgttgagggcggtttcgggcgtagaaacgaaatttagtttttggtttcgtatttgtagtatttgtttcgcgggaattcgcgggagacgtaggttttcgggttcgaatttaggtttgttgaattagatgttcgttttattaggttcgtttgaggattaaggtgtttcggaggttttttaatggttcggagttatttaagtttgtacgtatttttgaatttaggtatgttttttttttcgtcggttttgaaaatagatgtattggtaattgggggtttttagtttttttttagggtttattgggatgattttagtattagtagggatttttaggtattgtgtgttaatggttgtagagttttttttgtttcgaatttcgtttagtatttttatttttaattaggtatatttatattattttttttttttttcgtttttttttgtttatttttaggtttttttggagtttggtttatttggtttttttagggtggaaacgggtgtgtggaaggaaaataaaataaaataaataaaatagtaataataaagtttaaaataataaatataatataggtaatagttgttaggttaggttatcgtattttaggttaggttatcgtattttttgtgatttgtaggtatatatttagatggtttaaagtaattgaagatttataaaagaagtaaaaatagttttaattgatgatattttattattgtgatttgtttttgttttattttaattgattaatgtattttgtaattttttttatttttaagaaggttatttgtaattttttttatttttgagaatgtattttgtgagatttatttttgtttattagagaataattttttttgattgtaattttttattatttttttaaattttataaaacggttttatttttattttttttcgttgatttttttttcggatttagttcgtttgtatttaggtgaaatatatagttatgttgtttatataaagtttgtttggtggtttttttatatggacgtatatgaaaatagttaatatttagtataagttatttagaagtaatatataggttaaaattttaagtagttttttttagtattgtaataagttgtagatgtaagtttattttaaaagtttattatttgtttcgggattttagtttttaattttagtttagtttggaggatgattagttaatataattgaattgttagtttttttagaattgttacgggttaagtaatttattgtttttgtttgaaatttgtattttattttgttttttttattttaaacgatatataagttagttgttttttttgttggggttggtagttattttgggtatgagtttgttgttggttcgaattaaaagttttgttttggtttttaaaggtttttttgttttttttggttagagttttattgtaaaggtgaaaggggttggggagggttgagttaagtagatttatgggtggttttttttttgggagtttttattttcggttaattggttgtgagtgggagatggtatttttttttgggagcggttggtattttatttttattttttttagtttagtttatagttttttataagttttcgttaaagatttttatga

SEQ ID NO: 282 - DNA, 4433 bp, Artificial Sequence
  chemically treated genomic DNA (Homo sapiens)
ggtagaatcggtgtttatagttttcggggtttaattttattaggtaggaggagttgagttggttttgtaatcgaagtttaaggttagtgatggtagcgaggggtagagtttagggtaggggaaattagagtttttaggacgcggttagtagagttttgtttttgttgtagcgtcgggcgggggtttggtcgttatggttcggtttttatttaagacggttgtcgaggaggttcgtagagaggtattaggatagtaacggggtagtgttattttcgcggtttttcgagcggaaggaaaggagttttttaggttaggtattgtttttttgggtaggagcgaagtaggggggatgttcgttttttttttgatttattttatttttcggagttttggtagcgaagcggaggcggagataggtggtgttagggcgttttttcgttaggtcgtaggtttcgcggggtaataggatattggtttttggtaggcgggcgcggggttttcgggttcgatggggagaggtcggggtcggcggcggcggatggacgttggttcgggagatagagttcgtcgttttcggaaattggattcgtttcgtttgggcgtcgcggggagcgtgtgggacgcggtggacggggtcgtcgttttggacgtttacgcgcgcggtttttttataggatttttattcgtttaggagttcgtattttcggcgttgttcgtttttcgcgttttgtagtttgggttttagacggaaggttttggggttaagggtggttggagtagggaggtttcgggggtttttgttttcggaggaggttggttttgggttagtagggaggtttcgggtattcggagttttggtttagttttagattttacgcgtttttggttagagagttcgttttaaggtcgtttattttcgttttaagggtcgggtgttataggggtttacgatgtcggcgaggtcggggttgatagttttcgagataatagttttgtcgttgatttggggtttattcggttttcggagtaagtaaagtcggttgtagtcggttatagtcgcgcgttttttcggagtcgtgagtttcgttcgcgtttcgttttttcgttcgtagttttcggttcggggtttttatttgaagttttgattttttttttttttttagattttttgtttttggaggttatttaggattttttcgtgggcgaaaattttagagcggcgttagttttaagtttagttttagtttaagttttaattttagttttagttttagttttagttttagttttggttttattttttagtttagtattaattttagttattattttaattttattttttattttagttttagttttagttttaattttagttttaattttaattttagttttagttttaagtttagttgtagtcgtaattttagttttagttttagttttagttttaatttttatatttttatttttagttttaattttagttttaattttagttttaagtttagttttaattttagttttaattttagtcgtatttttagttttaattttagttttaattttagttttaagtttagttttaattttagttttaattttagtcgtattttttgttttagtttttattttagttttaattttaattttagtcgtattttttgttttagttgacgggttaaagttttaggagagtgtggttttttttaggcgttattaggaggggtaggttttagttagttggggaaattttattgttatggtttttagaagttattttttttttaggtaagataggttttaagggagtgtttcgagggcggttttcgggagtttcgtgggttttagtatttttatatattttgaggatagatacggttttttttttttagtggggatagttatagggataggtatagggggtttggttgaggttggaggttagttatagttaagaagtttcgagattaacggatcgtttagtttagatttttttttaggtttaagaggagagggaattagggagaaaagtttagattcgttgttttaagtcgcgatgtttaggggtttcgtatagtttttcgcgtagaggtcgtttggtttcgcggtttttttttttgcgaggcgtttatagtcggtattttagttacggaaacgtagtaggtgcgaaatcgtttcgagttcggagtaggaggttaggtcggtcgtttcgggggatttttaaggggaggcgtcgggggaggggggtagttttgtcggtcgtagcggggcgtttacggaaaagtaggaggaggttcggaagtttatggtgtttttgtagaggttcgggggttggggggtggtggaggggtttcggaagtttagttttcgggttttggagttcgttacggcggtagttttgcggcggcggttggatttgggtagttgtttggacgtgttggtttttgtttagtagtacggagagttcggtttggcgtaggagatttacgcgttgatgagcgataatttgttgcgagtgttgggagattcgtgtttttatcgtcggttgagcgcggtcgatcgcgagcgtatttttagtttgcggatcggtcggggtcgggcggtgttgggcgttttcgtattgtttagtttttattaggggggtcgtttagggttttttaggggttttcgtggcgaggagttttttgcggcggtttttgtgtttttgtttttatttgcgtatttgtatgtgtttaattttcgggagaatatttggcggtttttgatttaggtgttcgaggaggtttcgtttcggggttgcggtttttgtattatgtataattatttgtttttggcggggggtattcgtggtttcggtgttaaggtcgtttgttttaacgaggttttttgttataattttttgattaatatttggagttaggttcggtttatgtagtaggttcgagtttagtttaagttggtggttttggacgggttgttttatgttatcggtggcgaatgtttgtatagtatggagtgttacgattcgcgaatagacgtttggattttacgcgcgttatttttcgtaggtattttttttgtggtttacgaggttgtggtttgtcgtggggatatttacgttatcgggggttattttttttatcgtttgtttaggtatagtttcgtgaaggatgtttgggacgagtgtttatatagtgttagttatcggcgttttagcgatatcgtggtattggggggttttttgtatcgtttcgatttgttgcggggcgtgggcgtcgtcgtgatgcgttataatatagtgatcggtttttggagtagggttgtttttttgtttttgttcgttttcgttttattgtattgtattattttgggtaatattatttattgttttaatttttaggttattgttatttttacggtttttggggggattgtttagttttaggttaaggagttgtagtttttttttttggggagtatcggggtttttagtttatttattttgattttgttttttgaggatcggttgtagattttattttgagtggtaggtagagaattaaagttgtttcgttgttttttagggagatttttttgggatgggtttgagaggtcggggtttagggaaggggttgggatcggaattttttgtttttgtttttggataattttttttttttgttttaaaggttgtcgattattttgaagtttagatttttttagtttttttttgttttttattttatatttagattgttttttgatttaatttcgtatttatttatagatttttttagtttgttgatatttttttgtttgtgggattttttattttttagagttagggattgatgcgtttttatagataaggatttggttcgttggagttttgttgagtcgagagaggagggggtagaaaatatttatattttttatgttttgttagtaggatagggagtaaaaacgtttttaggtaacgttttcgtttttgggattttttgtttgttttaaggtttttttaggtattaatttcgtagttatttgggtttgtttggtattgtggatttttaagggtttagaatttttgtttttgaaattggttcgttggtgtagttttgttgtttgtagtttttgtttatatttttagtttatattaggttaggtttatttcgggtttattattttttgtagttttgtggggtttttttagtttttttagaagtttattttatttttcgttaattttcgatttttaaatgaggtttgagcgttattttagttttgtttttttttagttgtgtagatttggacgagatatttgatttttttttttttttgtttataaaatgtggatagtggacgtttgttatttaagagagttgtgggagataagattatagttatgagtatttcgtacggtgtttaggatg

SEQ ID NO: 283 - DNA, 4433 bp, Artificial Sequence
  chemically treated genomic DNA (Homo sapiens)
tattttggatatcgtgcgaggtgtttatagttgtgattttgttttttataatttttttgggtgatagacgtttattgtttatattttatagataaggagaaagggaagttaaatgtttcgtttaagtttatatagttaaaaaggggtagaattagggtgacgtttaggttttatttagagatcgggggttggcgagaagtggggtgggtttttggaggggttgggagagttttataaggttgtagagggtggtgagttcggagtgggtttggtttggtgtgggttgggggtatgggtaggagttgtagatagtagggttgtattagcggattagttttagaggtaagggttttaggtttttgagaatttatagtgttaaatagatttagatagttacggggttggtatttggggaggttttaggataggtagaaagttttagaggcgagggcgttgtttggggacgtttttgttttttgttttgttgatagagtataggaagtgtgaatgttttttatttttttttttttcggtttagtagagttttagcgagttaagtttttgtttgtggagacgtattagtttttggttttagggaatagggagttttatagataggggggtgttagtaagttgagagggtttgtaagtaggtacggaattgagttaggaaatagtttgggtgtggagtgaggggtagaaagaggttgagggagtttgggttttaaaataatcgataatttttaaagtagaaggggaaagttgtttagaaataagagtaggaagtttcgattttagttttttttttgagtttcggttttttaggtttattttaggagggtttttttggagagtagcgaagtagttttggttttttgtttgttatttagagtgaggtttgtagtcggtttttagggggtagagttaggatgaatggattgaggatttcggtgttttttaaggggaagggttgtagttttttggtttggaattgggtagtttttttagagatcgtgaaggtggtagtgatttgggggttgaggtagtaaatggtgttgtttagggtggtgtagtgtagtggggcgggggcgggtaggggtagggaggtagttttgttttaggagtcggttattgtgttgtagcgtattacggcggcgtttacgtttcgtagtaggtcgaagcggtataggaagttttttagtgttacgatgtcgttggaacgtcggtggttggtattgtatgggtattcgttttaagtattttttacggggttgtatttgagtaggcggtagaagaggtgattttcggtgacgtagatgtttttacggtaggttatagtttcgtgggttatagggaaggtgtttgcggggagtggcgcgcgtggggtttaggcgtttgttcgcgggtcgtagtattttatgttgtataggtattcgttatcgatggtatagagtagttcgtttagggttattagtttgagttgggttcgggtttgttgtatgggtcgaatttggttttagatgttggttagagggttgtagtagaagatttcgttggagtagacggttttggtatcggagttacggatgtttttcgttagaaataggtagttgtgtatggtgtagagatcgtagtttcgaagcggggttttttcgggtatttgggttaggggtcgttaggtgttttttcgggggttgaatatatgtaggtgcgtaggtagaggtagggatataggggtcgtcgtaggaggtttttcgttacgagggtttttggggagttttgagcggtttttttggtagaggttgggtagtacgaggacgtttagtatcgttcggtttcggtcggttcgtaggttgaggatgcgttcgcggtcggtcgcgtttagtcggcggtagaggtacgggttttttagtattcgtagtaggttgtcgtttattagcgcgtaggttttttgcgttaggtcgggtttttcgtgttgttgggtaaaggttagtacgtttaggtaattgtttaggtttagtcgtcgtcgtagggttgtcgtcgtggcgggttttagggttcgggagttgggttttcggggtttttttattattttttaattttcgggtttttgtagaaatattatgagttttcgggtttttttttgttttttcgtgagcgtttcgttgcggtcggtagggttgtttttttttttcggcgtttttttttgagggtttttcgaggcggtcggtttgattttttgtttcgagttcggggcgatttcgtatttgttgcgttttcgtagttggggtatcggttgtgagcgtttcgtagaggaggaggtcgcggggttaggcggtttttgcgcggggggttgtgcggggtttttgggtatcgcggtttggggtagcgggtttagatttttttttttggttttttttttttttaggtttgggggagggtttgggttgggcgattcgttggtttcggagttttttggttgtggttgatttttagttttaattaggttttttgtatttgtttttatgattgtttttattgaagaagaggggtcgtgtttgtttttagagtgtgtggaagtgttgggatttacggggttttcgggaatcgttttcgggatatttttttggggtttgttttgtttggggaaggggtggtttttaagaattatggtaataaggtttttttagttggttgagatttgttttttttggtagcgtttggggagagttatatttttttgaggttttgattcgttagttggggtaggggatgcggttggggttggggttggggttgaggtgggggttggggtaggggatgcggttggggttggggttggagttggagttgggtttagggttggggttgggattggggttagggttggggatgcggttggggttagggttggagttggagttgggtttagggttggggttgggattggggttagggttggggatgggggtgtgagggttgggattgggattggggttggggttggagttgcggttgtagttggatttggggttggggttggggttgaagttggagttgaggttggagttggggttggggttgaggtgggggatgaggttgaggtggtggttgaggttggtgttgagttgggggatgaagttagggttggggttaggattgaggttggagttgaagttaagatttgggttgaggttgaatttggggttggcgtcgttttgagattttcgtttacggaaggattttgggtaatttttaggggtaaaaagtttgaaggagaggggagagttagggttttaggtgggaatttcgggtcgggagttgcgggcggggaggcggagcgcgggcgaggtttacggtttcgggagggcgcgcggttgtggtcggttgtagtcggttttgtttgtttcgggggtcgggtgggttttaggttagcggtaggattgttatttcgggagttgttagtttcggtttcgtcggtatcgtaggtttttgtggtattcggtttttgggacgagagtgggcgattttgaggcggattttttagttaggggcgcgtggagtttggggttgggttaaagtttcgggtgttcgggatttttttgttgatttagggttagtttttttcgggggtagggattttcgaggtttttttgttttagttatttttggttttagagtttttcgtttgagatttaggttgtagggcgcggggagcgggtagcgtcgggagtgcgggtttttgggcgagtgggggttttgtggggaggtcgcgcgcgtgggcgtttagggcggcggtttcgtttatcgcgttttatacgtttttcgcggcgtttaggcggagcgggtttagttttcgggggcggcgggttttgtttttcgagttagcgtttattcgtcgtcgtcggtttcggtttttttttatcgagttcgagggtttcgcgttcgtttgttaggggttagtgttttgttgtttcgcggggtttgcggtttggcgagaggacgttttgatattatttgttttcgttttcgtttcgttgttagggtttcgaggagtgaagtggattaggaggggggcggatattttttttgtttcgtttttgtttaggagggtagtgtttggtttgggaggttttttttttttcgttcggggggtcgcgggggtggtattgtttcgttgttgttttaatgtttttttgcgggttttttcgatagtcgttttgagtggaagtcgggttatggcggttaggttttcgttcggcgttgtagtagggatagggttttgttggtcgcgttttgggggttttggttttttttgttttgggttttgtttttcgttgttattattgattttagatttcggttgtagggttagtttagttttttttgtttgatgaggttgagtttcgagggttgtggatatcggttttgtt

SEQ ID NO: 284 - DNA, 4494 bp, Artificial Sequence
  chemically treated genomic DNA (Homo sapiens)
attataaattagtattattataaaggtaagatgattgtgattaggttaaatttttaatagagggaaataaaatttaagaggaagttagatttaaaaataaataaataaataaatattagggtagtgaaatattatatagattagggtttgttaaatttatatttttattaatatattagttaaaattattaatttagataataattatgtttttttcgatagttaaggttttattattattgtttttatttattttttttttatagttatttgtagtagatttattttttaagttttataaaagatagttaattcgtaattatatttttttagtggatatagagagaattagataaattatttttaaattttagtagattgaattatttatttttttattaatatttcgtaaaatggtataatgtgaattttatttttattttttaaaggagttaataatagttattgaaaaggttttaaaagatggtagaaagagtatattaatgtaattaaatagattaaaaattaaattcgaatttgtttatatgttttttttttttatatagaaagaaatattgtttaataaagttatatatttaagttttgataaaagttttaaaaatacggttattatatgtttttaattttttaaatgtatggtttttaatttgtagtaagattattcgggaaaattggaataattttataaataaatgtaagtaagttatgagagaaattagaatttttttagttaagtgtatttttttaaaatatggaaaacgaaattttttaatttttaaaataatttgttttaattagttttaaggtgatttttgagttatttgtgggtaaaaattagaagagaaaaaagtttaatgattttgtaaattagaaattaaaaaattaatggtgtgatagtttgtatagttttagtggaattataggaaaatatttgttcggaaattgtttttttttttttggaaaattattaggaggttgggggaaaagaggggaaaaacgggtaaggaaggttgtaaatgttaagatgttaaataggaatttaatcgaagttcgaagtgaaatatagttttttttggtttaattgttatgtaaataatttttaagtatttttagatgtaaagaaaaatagttattgtgtataggcgttagttgaatgttcgagagttggatgaatggggaagatttgttatatatttagtggtgggtggattttattaggttgtagtttttatatagtttttttttgttgtattgtagaggcgttatttttttcgttttaatttttatttaattcgatttttttatttgtattttaaaaaaaagatttttcggattttttttagtattttgtgtttttaggggaattaaattagagtttttagagttgttagggaagaggtcgcgttttaattagataaacgtttttttggatgtataggatagagttcgtgtttttttattattcgttattgttttttttagacgtatattttatttttcgttttatttttttttcgttaaggattttatagtttagtatagaattaagtttcggaggtgattcgagggtgggaagtagaggggtttcgaggtttcgttagaagtttcggtagcgtttttgtttttttttaggcggacgcgtagtttcgggaagggagtcgggcgggagtttcggtggcgtattgagattaacgcggttcggtttacggcgagggcggggtgtcgcggtttttgttttcgcggattttttgttttttagatagagtttagggtgcgagcgaattttcgggacgtttagatttggggaaggcgcggggtggttatgggttttcgattttttttatttttcgtaagttatataaaagggagacgcggatatgtataaagtttgtttgtggaaggcggtgcgcgatttcgacgtcggttcgggttagggtcgtatttaggttgtcgtcgttagtagtcgcgaaaagaggttggagtaaggaagggggatgggggtgagagaggaaggtgaaacgaggcggagaacgtagggaaaagcgaggggtttttagttttttgggttgtttcgattttttttttttttttttagggtttaagagaaaggaaagggtaacgatttaagagcgaaggattggttttagggacgttgcgttttcggttttttttacgtgttttttttttttttttttttgtttgaatgtttttcgtttttttcgattttcgtttttaaggtagggattaagtcggggtttgggtttagggtcgttttttatttttttcgtttcgggttggcgcggaattagggagattagcgtttcgttcgtttttttttagcgggtcggagcgcgattttttggggtagggttgggtcgaaagcggggatgcgttggacgttcgtaagcgggggcggagaggagaggggttttattgacggattttcggtttttttgtattaaagatttgggttaaggttttggggggtatcgcgtttttatcgtgtagttttttttcgtttttcgaggcgcggtatttatttttagcgttcgagtcgtttaggcggttagtaggagtagtgttaaatcgggtagtatcgcgattttgcgcggggtatcgagtgcgttgttgtgcgagtgggattcgtcgcgtttttgttttgttcgcgtcgttatcgtcgtcgtttttcggggttttcgcgtacgttttttcgcgtgttttcgtttatcgttgtcgaggaaattgacggagttcgagcgcggcggcggggtttagagttaggcgagttagttgattcggtttatttcgttcggtattcgagagagatttttagcggcgtcgtcggggaattgcgttcgttcgcgtcgggaggggttttcgcgtttcgcgtttataggtgtacgcgtttttggcgtcgtttgtattttacgcgtttttttcgtttttcggtcgacggtttatttgggtttcgtgaatagtgggagggagagtttggggttaggagagggacggtgtaggattagggaaaggtgagttttaggacgttgaggttttagaaaagtcgagagcgtttttgttcgttttcgtgagtttgaattattcgatttcgtaggtttttcgggggtgtcgtataaaggattgttgttagggtgcgtttttattcgtatttcgttttttttttcggtttggagaggtggggtaggcgtttttggaagagaatgagaacgagtgaagtttaaaggaaataggattttttttgtttgttgagatagtaaaattttattttttaatttttaacgttaaaagtaggtacgagtaatttggaatttttatttttagaacgaattaaaggagtaaggcgtaggatttggtaaagaagcggttaatttatttatttttttttgaaagtagggttttgggtttgggttttgttttttttttatatttttgtttgtttttggttttgttttgttaaagggggtggttagtgtggattttgcggggcggggggtttttttttgttgttaagtagggatgtaatatttatttgagttggggaagaaggaaaaattaggagagattattcgtattcgattttcgtaaatgaggatttttgattttaaacgttgtttttgttttttattgtgtttgttttgaattatagaaatgaattttttgttatgttatttttttttggattaaatataaatcgtttattgtttagttagtgtttagatagtttagaatgttttagaattgtttagatatattttttgtttttgatttgaagtagtatttagttattaagttatagtttattttatatagggtttggagcgaaggattgaagttagggagtgttttggtttttttgagggttgtattgtagtttgtttttttttttttgtttattgcgttgataagggtgtttaggttcgggaaggatggtttagttagcggggtatagattttttttttgggaagttatttttgtattagtttttttaaatgttgttttgtgtgttttttttcgtattaggtatttagttttgatttttggattatttttgtttttgaatgttttttggatgtttttaataaataaggataaatatttattgttatgtagtatttgtttatacgttttatgttatttattttttataaaagttaaagaggttgttattattatttttatttatatattaggaaaatgaagttaatgaatttttaaatttaatagtaagtaagtgatatgaagttgggatagtagggaaaagtttaaagtgataggataaatttagttgtttattttttgtattatatttatttatcgtaatttcgtatttgtttcgggtttgtatgagtaaataaggtaaaaaagaaggtatttgaatgtaaagagaaacgtggtttaaagttataaattttgtagagtttattgtaaaatgtaaacgtgagattttttgttat

SEQ ID NO: 285 - DNA, 4494 bp, Artificial Sequence
  chemically treated genomic DNA (Homo sapiens)
gtaataaagggttttacgtttgtattttgtagtggattttgtaagatttgtagttttggattacgtttttttttgtatttagatatttttttttttgttttatttgtttatgtagattcggaataaatacggaattgcggtgggtaaatgtggtgtagaaagtgaataattgggtttgttttgttattttaggtttttttttgttgttttagttttatgttatttatttgttattagatttgggagtttattagttttatttttttgatgtataaataggaataatagtaatagtttttttggtttttgtaggaagtaaatgatatgaagcgtataaataaatattgtatgataataaatatttgtttttatttgttgaggatatttaaaggatatttaggggtaaaagtaatttaagagttaagattgaatgtttagtgcgggaaaagatatataagataatatttaggggagttggtatagaaatgattttttaggaaggaagtttgtatttcgttggttgagttatttttttcgggtttaggtatttttgttagcgtaatgagtaagggagagaaggtaggttgtagtgtagtttttagaagggttagagtattttttggttttagtttttcgttttaagttttgtgtggagtgggttgtggtttggtaattaaatgttattttaggttaagagtaggggatatatttgggtagttttagagtattttaaattatttggatattaattggatagtggacggtttgtgtttaatttaggagaaagtggtatggtagaaggtttatttttataatttaggatagatataatgaagaataagggtagcgtttgaggttagaagtttttatttacgggggtcgaatacgaatgattttttttaattttttttttttttttaatttagatggatgttatatttttgtttaataataaaaaaagatttttcgtttcgtaaaatttatattgattattttttttaataaaataaaattaaaaataaataaaaatataagaaagaaataaaatttaagtttagaattttgtttttaagaagaagtaaatgggttggtcgtttttttgttaggttttgcgttttgtttttttggttcgttttaaagatagaaattttaggttgttcgtgtttgtttttgacgttgggggttaaaaaatgaggttttgttgttttaataagtaaagaaaattttattttttttaagttttattcgtttttatttttttttagaaacgtttgttttatttttttaaatcgagagaaaaaacgaaatgcggataaaaacgtattttagtagtagttttttatacgatattttcgggaggtttgcggggtcggatgatttaagtttacggggacgagtaggagcgttttcgatttttttagagttttagcgttttaggatttatttttttttgattttgtatcgttttttttttggttttagatttttttttttattgtttacgaagtttaggtgggtcgtcggtcggggagcggagggggcgcgtggggtgtaggcggcgttaagggcgcgtgtatttgtgggcgcggggcgcgagggtttttttcggcgcgagcgggcgtagtttttcggcggcgtcgttaggggtttttttcgggtgtcgagcggggtgggtcggattagttgattcgtttggttttgagtttcgtcgtcgcgttcgggtttcgttagttttttcggtagcggtaggcgagagtacgcggaggagcgtgcgcgggggtttcgggagacggcggcggtggcggcgcgggtagagtaaggacgcggcggattttattcgtatagtagcgtattcggtgtttcgcgtagggtcgcgatgttgttcggtttggtattgtttttgttggtcgtttggacggttcgggcgttggaggtgggtgtcgcgtttcggaaggcggggggaggttgtacggtggggacgcgatattttttaagattttaatttaagtttttaatgtagagaagtcgggggttcgttaatgggatttttttttttttcgttttcgtttgcggacgtttagcgtattttcgttttcggtttagttttgttttagggagtcgcgtttcggttcgttgagagggagcgggcgaggcgttggtttttttggtttcgcgttagttcggggcgagaagggtagggggcgattttgagtttagatttcgatttagtttttgttttggaagcgggggtcgggggaggcgagagatatttagataggggggaagggggaaggagtacgtggggaaaatcgaaaacgtagcgtttttaaagttagtttttcgtttttgaatcgttgttttttttttttttttgggttttggggaggaggaggaggagtcgggatagtttaggaagttaggagtttttcgtttttttttgcgtttttcgtttcgttttattttttttttttatttttattttttttttttgttttaattttttttcgcggttgttggcggcggtagtttgggtgcgattttagttcgagtcggcgtcggggtcgcgtatcgttttttataggtaaattttgtgtatgttcgcgttttttttttgtgtaatttgcgagaaatgggaggggtcggagatttatagttatttcgcgttttttttaagtttggacgtttcgggagttcgttcgtattttaagttttgtttgagaggtagaaggttcgcgggaataaaagtcgcgatatttcgttttcgtcgtgggtcgagtcgcgttagttttagtgcgttatcgaggttttcgttcggtttttttttcggggttgcgcgttcgtttgggagggggtagagacgttgtcggggtttttggcggagtttcggggtttttttgttttttattttcggattattttcgaggtttaattttgtgttgggttgtaaagtttttggcggggaggaaataaggcggagagtgggatgtgcgtttggaaagggtagtggcggatggtggggaggtacgggttttgttttgtgtatttaaggaggcgtttgtttgattaaggcgcggttttttttttggtagttttggggattttggtttagtttttttgggggtataggatgttggggagggttcgaagggttttttttttagggtgtagataaaaggatcgaattgagtgaagattaagacggagaagatggcgtttttgtagtgtagtaaagaaaagttgtgtggaggttgtagtttagtgaaatttatttattattaggtgtataataagttttttttatttatttaattttcgaatatttagttaacgtttgtgtataatgattgtttttttttatatttgaagatgtttagaagttgtttgtatgatagttgggttagaggaggttgtattttatttcggatttcggttgggtttttgtttggtattttaatatttgtaattttttttattcgttttttttttttttttttttagttttttagtaattttttaaaagaaaaaaagtaattttcgggtagatgtttttttgtaattttattgaggttgtatagattattatattattagttttttagtttttaatttgtaaggttattgaattttttttttttttgatttttatttataagtggtttaggaattattttagggttagttaagataggttgttttaagagttaaagaatttcgttttttatgttttaaaaaaatgtatttaattaagagaattttgattttttttatgatttatttatatttatttgtagaattattttagttttttcgaatggttttattatagattaaaaattatatatttaaggaattaaaagtatatgataatcgtatttttgaagtttttgttaaaatttaaatatgtaattttgttgagtaatatttttttttgtataaaaagaggaagtatgtaggtagattcgaatttagtttttggtttgtttaattgtattaatatgttttttttgttattttttgggatttttttagtagttattgttaatttttttaaagggtggaggtgagatttatattatgttattttgcgaagtgttggtagaagggtaggtaatttagtttattgaggtttgagggtggtttatttggttttttttgtgtttattgaaaagatgtaattacgagttgattgttttttatagagtttagaaaataggtttgttgtaggtggttgtagaaaagaaatgaataagggtaatgataatggggttttggttatcgggggaaatatggttattatttgggttgatgattttggttggtatgttgatagaggtgtgagtttaataaattttaatttatatgatgttttattattttaatatttatttatttatttatttttaaatttagtttttttttaagttttatttttttttgttgagggtttaatttagttataattattttatttttgtggtagtgttaatttatagt

SEQ ID NO: 286 - DNA, 4489 bp, Artificial Sequence
  chemically treated genomic DNA (Homo sapiens)
taaaaagatttaaaaagataatgtataaaagatttaagaattaaaaagataattttagaaagaggaaatttaaatagtcggtaagtttttgaaaaagtgtttaaattttttagtgttttgggtagaataaattaaaataataataagataaagttatatttattaagttgggaaaaaggaaaaataatttttggtgagatagtaaaagtaaagggatttattatatattgttgtcggggtatatattggtgtatttattttggaaaaggtataattagtgaagttgaagataaatatacgtattttataaaaatttatggtaatgtatattaagaatatatgtataagaatatttataatagtattgtttataattattaaaaacggaatataatttaaatgtttattaatattagattaaattgtggtttatttttattaagattttttatattatatttattatattatagattattataatttaatataagaattagagttaaatgtattaatagagttatattttagttgtatgagagaaaaagatatataatgatatgtaatatataatttatttatatataattaagaaataggtaaaacgaatttaaattgtttaggaatgttgatataggtggttaagaaatattaagaaagaaagtagtaaatgattgttataaaaattagtatagtgttaattattgaaaagaattgaggaaagggatgattaggaatagaatggagaggggagttttttaggtgttatagacgttttagtttttgattgtggtagcgtttatatagagtttatattttatagttttttattatattatgtatcgatgtttgtatgtttaaatattaaatgtatggaaaaagatataaaatatttaaaattgtagttaaggtatattaattgttttgttggtattttttttttttattataaagtggtagataattggttatattataaagatagataattggttatattataaagaaaattttaaagtataggagtttagttttgattttatcggatatgattatcgtatataatatagaagatattaagggttaagtaatgatgtataaacggggtttattgtttaaatttatagaaagtaaaacgtggaaaattagtaattttaattgatagtgtatatttaaagaatttatatcggtcgggcgcggtggtttacgtttgtaattttagtattttgggaggtcgaggcgggaggattatttgaggttaagagatcgagattagtttgattaatatggtgaaatttcgtttttattgaaaatataaaaaaattagttaggcgtggtggtatatgtttgtagttttagttattcgggagggtgaggtaggagaattgtttgaatttaggagatagaggttgtagtgagtcgagatcgcgttattgtattcgtttgggagatagagcgagatttcgttttaaaataaaaaataaataaaaagaatttatttaatagaattaagtattaatataataaatacgaagaattttagatttttggtttttaaaaaatatataaagatgatatttttttaaaatatttttataaaatatattgagattgtgatgttttatattgattgtatgaaaataatgaaaaagaattagtattgttttattataaaagttttattaatgtaaatttataaatttttttttaaatattttgagttaattttaattttatgatagaaatttattatttttagtaaaaatagttggtatttgggaaattaaaggtttaaaaattaagaatagtaattaaagaaatttgataaaatagtttttttaaaatttttatttatattataaggggaaattttgattacgtttttttttttttattaatcgtagaatttaatattaaggattatataattttatattttttttcgagaaaaagtaaaggttttgtgttgtagtaataacgtaagatatggagggaagttttatttaagatttttttgtttgttttttttttaaagttattttagaatattagggagggttgagaggtaaggtatgaagggcgtaatatttaatatgagtaacgcgtgtgatgtatttggttaaaatgtatatagaggatttgtttttgtttttagatagaagtttttcgttttgtagttatgagggttaattgttgaggttttatagttttttttttttttatattcggatcgttacgttttttatttattatttcgatgtagaggtagatttaggatttttgtatttgttaaggatttttcggtaagtttacggggcgggagtggttataagacggagttcgtttggttttggttttttcggtttatataagtttgttttttttttaatttttaatttttatagttttttatttttttattttcgatttattttgcgttatcgacgtttttggttttcgtttgtagtaagtttatttttattattatttttcgtataaaagtttgtatttattaggttaaagaggggaattaacgtttgtaggaatcgttttatcgaatcgtttggtcgcgttttttgttagattttatttgtcgttgcggatcgtatataattattttcggtatgtttcgcgtacgtattattttttttatttcgtttttttttcgtttaaatacgtgattttttttcgttttcgtttacgtttattttcgtttttttatttttttttaggaaggaggagggagttgggggtgttaaaagcgtagcgatttttttttttttttcgttttcgtttttgtatttttcgttataatgtttttcgggtcgttagcgtttcgacgttttttgggaaaatagtttatttttttttttttttttttttttgtttttaattaattagttattcgttagagagggatatgcgtagtgagtgtttttcgttttttttattcgaatttttttttttttttaagtagagagattttagtagtagtagtagttgatgatgaagagagaggtagtggtagagggggggtattttttatttttatttttaaagggataggatattaattttattttattttaattttgaatttaggggggtggggggaaggcggttgagtttttttttttattttttagttttgagttttgagagggggattgagtttgagagaggagaaggagttttttttttttcgaaaatttttatttacgatttttatttttttatttttttaattcgtttttttttttttattttttttttttttggtcgtgagaggaggagagaaagaaattaaaagttttttagtaatatagattttttgttgttgttgttgttgttgttgttgttgttgttgttgttgttgttattgttgttgttgttattgttgttgtttggttttggttggagatattttattatatttaggagtagttatttttttagtttttttttttttttttcgttttttttttttttattttttttttttattattttttgtgttattttttatagttttagggaaggtatttaaaagtggggggtaggaaaggtaagtgtgtttgtgggggttttattgtttttttttggttttgatttttatttcggggtaatagtagtattaaattatatacgtagtggagtttcggggtgaggagggggtggtgttggggggggtgaaggaggggttggagtagggaggggtgtgtgaggtggggtgtttattttgttaggggaggaagggtatttttatttttatttgttgttgttaaaagtggttttttttttttatttaatatttgattgtgttttgttttagtgggggagaatataaaaataatttttttttttttttaatgaggcgttagggaaagagatagaaagaggtatattttttagatgttatttaaaaaaaatttattggagagttttttttttttaggaaaagttttattgtatttgtttttgagtgggaaaatgtcgggatttggattgtattggaattgtttatttatttgtagatttgagtgtttttttttttttggttttgtatgagatttggatattgattttagtgttggaagatttgattggtttttgttttaagggttttattttttattttttcgttttgtttgatttttatggaaaattttaaatttttagttggtagaggtttttggttaggttttgatttgtattattgttttttttttggttaaatgtttgttttatatattagtatataaagtttaaagttttaaaatgtttaaagtttaaatgttattgttattgtttgtttttatatacgtttttgatatttattttttatatgatgagaatattagttattttataattaatttgggtatatttgtaatttttgtaatttgtttgaataagtaatttttattgaaaattttatgttgttttggttgtatggaaggttaaatttttttattaatagtttgttgga

SEQ ID NO: 287 - DNA, 4489 bp, Artificial Sequence
  chemically treated genomic DNA (Homo sapiens)
tttagtaaattattgatggagaggtttggttttttatgtagttagaataatataaagtttttaatggggattatttgtttagataagttataaagattataaatatatttagattaattataaaatagttaatatttttattatatggaaaataagtattaggaacgtatgtgggaatagataatagtagtggtatttaaattttaagtattttagagttttggattttatatattgatatatgaaatagatatttaattaaaaaaaaagtaataatgtaagttaaaatttaattaaaggtttttattaattaaaaatttgaaattttttatggaagttagataaaacgaaaaaatggaaaatgaaatttttaaagtaaaaattaattaagttttttaatattgaagttaatatttaaattttatataggattaaaaaggggaaaatatttaggtttataaatggataagtagttttaatataatttagatttcgatatttttttatttagaaataaatgtagtggagttttttttggagaaaaagagttttttaatgaattttttttaagtgatatttagaaagtgtgtttttttttgtttttttttttggcgttttattggaggaaggagggggttgtttttgtatttttttttattggagtaagatataattagatgttagatggaggagagaaattatttttgataatagtaaataaaaataaaagtgtttttttttttttgataggatgggtattttattttatatatttttttttattttaattttttttttattttttttagtattattttttttttatttcggagttttattgcgtatgtggtttggtgttattgttgtttcggagtgaaagttagagttagaggaaggtaatgaagtttttatagatatatttattttttttgttttttatttttgagtgttttttttggagttgtggaggatgatataaagggtaataaagggggggagtggaggaggaggaggcgaaggaggaggaggagagttggggaagtggttgtttttgggtgtagtgagatgtttttagttagggttaagtagtagtagtagtagtagtagtagtagtagtagtagtagtaatagtagtagtagtagtaatagtagtagtaaagggtttgtgttgttaagaggtttttggttttttttttttttttttttacggttaaagaggaggagggtggagggagggaggcgagttggaggggtgagggggtaggagtcgtggatgggggttttcgaagaagaagaaattttttttttttttttaggtttaattttttttttagggtttagggttggagggtgggggaaggaatttagtcgttttttttttatttttttgaatttaaggttgaagtggggtagaattagtgttttgtttttttaaaaatagaaataaaaggtgttttttttttgttattgtttttttttttattattagttgttgttgttgttggggtttttttgtttgggggggagggggggttcgggtagaagagacgggaggtatttattgcgtatgtttttttttgacgggtggttggttggttgaaggtaggaggagggggaggggaggaaatgagttatttttttagaaggcgtcgaggcgttagcgattcggaagatattgtagcgggaggtataggagcgggggcggggaggaggaggaagtcgttacgtttttaatatttttagttttttttttttttttaagggaaagtggaggaacggaagtgggcgtggacggagacgaaaggaggttacgtgtttgggcgggagaggggcggggtgggagaggtagtgcgtgcgcggggtatgtcgggagtggttgtgtacggttcgtagcggtaggtgaagtttagtagaggacgcggttaggcgattcggtgaagcgatttttgtaggcgttggtttttttttttgatttggtaaatgtaggtttttatgcgagaggtaatggtgggggtaaatttgttgtaaacgaaggttaggggcgtcggtggcgtaaggtgaatcgaaagtgggaggatggaaggttgtggagattgggaattgggaagggggtaggtttgtataggtcgggaaggttaggattaggcgagtttcgttttgtggttattttcgtttcgtgagtttgtcgaggaatttttgataagtgtagggattttgagtttatttttgtatcggggtagtaggtgaggagcgtgacggttcgagtgtaagagagaagggaattgtgaagttttagtaattgatttttatgattgtaggacggaggatttttatttagggatagagataagttttttgtatgtattttgattagatgtattatacgcgttgtttatattggatattgcgttttttatgttttattttttaattttttttggtattttggagtggttttggggaaggagtaggtagggaagttttgagtggagtttttttttatgttttgcgttgttgttataatataaagtttttgttttttttcggagagggatgtgggattgtgtagtttttaatgttgagttttacgattgatgaaggagaagggacgtgattaaagtttttttttatagtgtagatgagagttttaaaaggattgttttgttaagtttttttggttattatttttagtttttgagtttttggttttttaaatgttagttgtttttgttgaaaataatgaatttttattataaaattagaattaatttaaaatatttaagaaaggatttataaatttatattagtaaagtttttatagtgaaatagtgttggtttttttttattgtttttatataattaatataaagtattatagttttaatatgttttgtaaagatattttgaaggaatattatttttgtatgttttttaaaaattaagaatttaaaatttttcgtatttattatgttggtatttaattttgttgggtgggttttttttgtttgttttttgttttgagacggagtttcgttttgttttttagacgagtgtagtggcgcgatttcggtttattgtaatttttgttttttgggtttaagtagtttttttgttttattttttcgagtagttgaaattataggtatgtgttattacgtttggttaatttttttgtgtttttagtagggacggggttttattatgttggttaggttggtttcgattttttgattttaaatgattttttcgtttcggttttttaaagtgttgggattataggcgtgagttatcgcgttcggtcggtgtaggttttttaggtgtatattattagttaaagttattaattttttacgttttgttttttgtaagtttgggtagtggatttcgtttatgtattattgtttagtttttagtattttttgtattgtgtacggtaattatgttcgatggaattaaaattagatttttgtgttttaaaattttttttgtagtgtaattaattgtttgtttttatagtgtaattaattgtttgttattttgtaatgaaaaaaaaaaatattagtaaggtagttaatgtgttttagttataattttaaatattttgtgtttttttttatatatttagtatttaagtatataaatatcgatatatagtataatgaaaaattataaagtgtgaattttatgtaagcgttgttatagttaagaattagaacgtttgtggtatttgagaagtttttttttttattttatttttgattatttttttttttaattttttttagtggttaatattatattgatttttatggtaattatttattgtttttttttttagtattttttaattatttatgttagtatttttaagtaatttaggttcgttttgtttgttttttaattgtatgtaagtggattatatattatatattattatgtattttttttttttatgtagttgggatataattttattagtatatttagttttagtttttatattggattgtagtaatttatagtataataagtatagtataaaaagttttaatggaaatgagttatagtttagtttaatattaataaatatttggattgtgtttcgtttttagtagttatgaataatgttattatgaatgtttttgtatatgtatttttaatgtatattattatgggtttttgtagagtacgtatgtttatttttaattttattagttatgttttttttaaagtagatatattaatgtatatttcgatagtagtatatggtagatttttttatttttattgttttattaagagttatttttttttttttttaatttgatgaatgtggttttattttattgttgttttaatttattttgtttaggatattaaagagtttgagtatttttttaaaaatttatcggttatttgaattttttttttttagaattgtttttttaatttttaaattttttgtgtattgtttttttaaatttttttg

SEQ ID NO: 288 - DNA, 4395 bp, Artificial Sequence
  chemically treated genomic DNA (Homo sapiens)
ttttttttgtatgttttgtttaagttttatattgtattgatttttgtgtttttgaggtggtttgtttttttgttaaaaaaaaaaaaaagttttaaaaagagttattatttaattttttattgtattaaaaatagaggatatttttataatatttattagtaaattaatttttaaatgttgttttagttaaattaattaattatatatattataataggtttagatattttggaatattaatagtaggaggaaaataggaaaatataaaataattcgaggttttttattagtatttttttaagtaaatatatttgttttttttttggttgttttagataaatggaggatgattaaatttgttataattgaaatagaaaagaaaaattagagataaaatatattgaaatgattaaattttataaaaatataatataattttaagataaaataatattaaagtagattaatttttttattgttaattgttagaagtcgatttagaatttgtaaaaattaatttgaaatgtataaattaggaaattttgggatttttttaaggaattaatgtaagttaagaatggatgagatttaaatttttaaggtaaatatattatttattttaaaggtaatatgttaatttatttatgttatatatagtatagtgggattataggagttatattgtatttaaattatttttagggaatggttttgttagtatttttgaatgaagagaggggttagaaggtaaaaaggaggaaaaggagaggtaaataatgagaatagttttatgattgtttttgatatattgtagtgtggttgtattttagaaaataaatatttagataaattttatagattgtggaggaggagaataagtaagaaatagattaatgtggattgtgggtattaagtattattattggaatgttgtttataaaaatgttttgaatttttaagtaatttcgttttttagtattttttaagttgtgaaattaattttttttaattttaatttgatttaatattaaattaatatatagaaattgattattaatttgagaaacgtgattttcgaaagtattatattgggttaggtttttagtgttaaagagattgtgatttgtaatttaatagtaaatttgtaatgttattataatttaaatttgttttattttcgtatttttgatttaattaatatttttataagataaaatattagtaaaatagtaagtaagttagtttttataatttgattttttttttatttttttttatttattttgttatttaacgatataaaaggtttatgtttttatatttttatttaaaatgaattcgggggagagaataatttataaatattttttgaattaaagtttattataggtttatatatttatatttaaatattattttaagaaacgtatttaggttttgatattaatatttaaaatattgttaattgtgtgttattttatgttttagttagtttatttgtattttaaattaaggtattggttgttgttgttattgtgtgtttttataggaaaaaaaaaattaatttaatttgttatgattttgtttatatttagaatatataggtatgtatattttttagtattaggatgtgtatttgtttatttcgttttttttgttttgatgaaattatattatagattacgtattgtgtttaatttagtagtaaattttttttaattgcgtggttcgcgattaatatttttatttttgtttagtaatgatatatttttattatatatttttttatattgttttttattcgatgattcgtgatattattttttttttatttttttttatttttatattgttcgcgttattatatatttataaagcgatattagcggtttttagggcggaaaggggtggaagttgattttcgtttttttttttagcgttggttttaggtgtgttttttgttattttttgtattgcgaataggggttcgtcgagtttcgggagtttttagaagaggaagatttttttggttttattaggtattattcgcgttttttcgttttttatttgcgttttcgtttgggttaatttttgtcgtacgtgtttatttttgaattgtacgttattttttattttcggggggtttttgcgtattgaaagatcgtttttcggtaggttttgggattcggcgacggttgatcgcgcgtcgtttttacgttcggttttacgatgttgtaatatagaaagtttacgtcggtttcgattcgcgcgggattgtagggttcgtcggagcgcggcgtagaggttttttttgcgcgttcggtttcgggaaaggggcgggagggttggtttcgggagcgtacgggcgcggcggggagggtatttattgtgaagtacgttgcgtttatggattatgtttgtgcgttatattagaggtttcgggttttattaattttatttagagacgggaagatttttagtggcggggggaggatagggtcgagaggtgttaaagacgtaaagtaagaaggaaataaaggggggtcgagagggagatcgagaggaagggggagtttcgagtttacgttgtagttagattcggatgagttcgtttttcgtttcgggcgggttttcgttttcgttggtttttagcgtcgcgtagttagtagtatttttatcgtgacgttcgtattatattcgggcgtcggtcgttattattcgcgtcgtcgtcgttaggatttttttttcgggtatcgtcgtcgtcgcggggtcgggaggacgcggcgcgcgggaggcggcggtcgtagggcgagtttcgggacgtttcgagtcggggtcggggtcggggagagggcgtagcgaggtgggggttagtttagatcgacggtagcgacggagcgggcggcggcggcggcgtcggcggcggcggggtggtttagtttttagttttagacgcgtcgcgtagtaggtcggagtagttttttcgggaggatgtttagcggtagcgtttttcgttttagtttttggggatttttcgttgaggtattgaaggtaggaagaaggggttcgttatcggttcgtcgggttgcgcgttatttttgttattttgcggaaagaggagcgggtgggtgggcgtttgggaggcgggttggagggcggtgtaggggagcggggcggtcggggggggggtcggggggcggggaagggagggaggagaaaggagtcggaagagggtagagttattaaatgggttttttagttatggtttggggttttacgatttttttggaagttcggagtttgggtgggatagcgaggttgcgcgcggtcggcgtttcggggttggtgcgcggtagaatggggtcgcggcggcggtagtaaggatattttagtcgcgcggatttgggggaggggcggggagggggtgaggattcggttgggattcgcggttcggttcgttagggcgtagagagaggatgtagtcgtaaatttcgagtcggattttcgtgtcggacggaaggcgtggaagcgggaggggttttcgtgtgaaaattttttgtggggtttggtgttttattttttaaaggttagattttgcgggttttttgttttttatttttttttttttattcgcgtaaaggaattgggcgttttttttttttttttttttggggcgtaggtttcgtcgcggatttcgcgtttagtttgggagatacggtaggggcgcgttttagggaaaggcggtcgtaaaagtttcgcggttgagtattgggtttgatgtttagtttttttattaaattatttttgtaaagacgcgggttttttgtaattgagttttttatttcgaggtatttaaaattattttaaggtatatacggattttcgttttttcgcgttatttttttttataggttcgcgcggcgcgttaaagtttgggagatacgagttgcggggaaatagtatcggaagagttcgggtttgtaaaatgcgaattaatgaatacgaaataagggtaatcgcgaggtagcgtcgggaagggttggagcgcgcgggggtgtagggagtttttttttgggcgtcgtaacggtattttttttttttttcggtttcgtttcgttttttttcggtttttgcggacgcgatttacgtagattatagtcgagttcgtcggatttcgggattacggaagttatttcgttcggttatttatattcgcgtcgcggttggggtttgggttggggattgtggcggcgaagaagtcggggtaggaagagttaatggtaatggcggggtcgtcggggggcggggggttagtagtagacgttgagttgtgaagattagggtggtttcgaaaggtcgaggaaaggagaaagggttatgagaagagtttggcga

SEQ ID NO: 289 - DNA, 4395 bp, Artificial Sequence
  chemically treated genomic DNA (Homo sapiens)
tcgttagattttttttatggttttttttttttttttcggtttttcggggttattttagtttttatagtttagcgtttgttgttgatttttcgtttttcggcgatttcgttattgttattagttttttttatttcggttttttcgtcgttatagtttttaatttaagttttagtcgcggcgcgggtgtgggtggtcggacgggatggttttcgtagtttcggggttcggcgggttcggttgtggtttgcgtgggtcgcgttcgtagaggtcgagggagggcgggacggagtcgggaaagggaggaggtgtcgttgcggcgtttagggagggattttttgtattttcgcgcgttttagtttttttcggcgttgtttcgcggttgtttttatttcgtatttattgattcgtattttataagttcgggttttttcggtgttgttttttcgtaattcgtgttttttagattttaacgcgtcgcgcgagtttgtaggaggaagtggcgcgggggaacgggggttcgtgtgtgttttggggtggttttaaatatttcgaggtggggggtttaattgtaagaagttcgcgtttttgtaggagtaatttggtggggggattggatattaggtttagtgtttaatcgcgaaatttttacggtcgtttttttttggggcgcgtttttgtcgtgttttttaagttgagcgcggagttcgcggcgaaatttgcgttttagggagggagggagagggggcgtttagtttttttacgcggatggaaaagaaggggtgggaggtagagagttcgtaaggtttaatttttaaaaagtgaaatattaaattttataagggatttttatacgaaggtttttttcgtttttacgtttttcgttcggtacgaggattcggttcgggatttgcggttgtattttttttttgcgttttggcgggtcgagtcgcggattttagtcgggtttttatttttttttcgttttttttttagattcgcgcggttgggatgtttttgttgtcgtcgtcgcggttttattttgtcgcgtattagtttcggggcgtcggtcgcgcgtagtttcgttattttatttaggtttcgggtttttaggagggtcgtggagttttaagttatgattaaggagtttatttggtaattttgttttttttcggttttttttttttttttttttttttcgtttttcggtttttttttcggtcgtttcgtttttttgtatcgttttttagttcgttttttagacgtttatttattcgttttttttttcgtaagatagtagaggtggcgcgtagttcggcgagtcgatgacggattttttttttttgtttttaatgttttagcggaagatttttaagggttggagcgaggagcgttgtcgttggatattttttcggggaggttgtttcgatttgttgcgcggcgcgtttgagattggggattgagttatttcgtcgtcgtcggcgtcgtcgtcgtcgttcgtttcgtcgttgtcgtcggtttggattggtttttatttcgttgcgtttttttttcggtttcggtttcggttcggggcgtttcggggttcgttttgcgatcgtcgtttttcgcgcgtcgcgttttttcgatttcgcggcggcgacgatgttcgggaggagggttttgacggcggcggcgcggatggtggcggtcggcgttcgggtgtgatgcgagcgttacggtggggatgttgttggttgcgcggcgttgagggttagcgagagcgagagttcgttcggggcggaggacggatttattcggatttggttgtagcgtgggttcggagttttttttttttttcggtttttttttcggtttttttttattttttttttgttttgcgtttttaatatttttcgattttgtttttttttcgttattggaagttttttcgtttttaaatggaattagtggagttcggagtttttggtgtaacgtatagatatgatttatgggcgtagcgtgttttatagtgagtatttttttcgtcgcgttcgtgcgttttcggagttagttttttcgtttttttttcggggtcgaacgcgtaggaaaagtttttgcgtcgcgtttcggcggattttgtagtttcgcgcgggtcggggtcgacgtaaattttttgtattgtagtatcgtggaatcgggcgtgggggcggcgcgcggttagtcgtcgtcggattttaaaatttgtcggagaacggttttttagtgcgtaggaatttttcgggggtggaggatagcgtgtagtttagggatggatacgtgcggtagagattggtttaagcgagggcgtaggtggaaagcgggagagcgcggatgatatttagtggggttagaggagttttttttttttaggggttttcggagttcggcgggtttttgttcgtagtataggaggtagtagaaggtatatttgaagttagcgttggagggaagggcgagggttagtttttattttttttcgttttggagatcgttgatgtcgttttatgggtgtgtggtaacgcgggtagtgtagaggtgggaaggaatgagaggaaaatagtattacgagttatcgagtaaaaggtagtataagaaaatgtgtggtggaaatgtattattattaagtaaagatgagagtgttgatcgcgggttacgtagttgagaggggtttgttgttgagttaaatatagtacgtggtttataatgtgattttattaaaataggaagagcggagtaaataaatatatattttgatgttgaaggatgtgtatatttgtgtgttttgggtgtgagtagaattatgataaattaaattgatttttttttttttgtggaaatatatagtaataatagtagttagtgttttaatttaaaatgtaaatgaattggttagagtataaagtaatatataattgataatattttaaatattaatattaagatttagatacgttttttagagtgatgtttaagtataaatgtataagtttgtggtgagttttaatttaggaaatatttgtgaattgttttttttttcgaatttattttaagtgaaaatgtgaaaatatagattttttatgtcgttggatgataaaatgaataagaaaaaatagaagaaaaattaaattatgaagattagtttatttattattttgttagtgttttgttttgtaaaaatgttgattagattaagaatacggaagtaaaataagtttagattataatggtattgtagatttattgttaagttatagattatagtttttttgatattggaaatttgatttaatataatgttttcggaaattacgttttttaaattaataattaatttttatatattgatttggtattaaattaagttaaggttagaagagattaattttatagtttagaaagtgttgagggacggggttatttggaggtttagaatatttttgtaggtaatattttaataatggtgtttaatgtttataatttatattaatttgttttttgtttattttttttttttatagtttgtaggatttgtttaagtatttattttttaaaatatagttatattgtagtatgttaggaatagttatggagttgtttttattgtttgtttttttttttttttttttttattttttggtttttttttttatttagagatgttggtagagttattttttaagggtagtttagatatagtgtgatttttgtagttttattgtattgtgtgtgatatgagtaaattgatatgttgtttttagagtgaatgatgtatttgttttaggagtttgggttttatttatttttaatttgtattagttttttaagggagttttaaggttttttgatttgtatattttaaattggtttttgtaagttttgaatcgatttttaatagttaataatgaaaaaattaatttgttttgatattattttattttgaaattatgttatgtttttatgggatttgattattttagtgtattttatttttaattttttttttttgttttagttgtagtaagtttaattattttttatttgtttggggtaattaagaaaggaataggtgtgtttatttagaaaaatgttagtggaagatttcgaattattttgtatttttttattttttttttattgttaatattttagaatatttgaatttgttataatatgtataattgattggtttggttaagataatatttaaaaattaatttattaatggatattataagaatgttttttatttttagtataatagaaaattggatgatggttttttttaaaatttttttttttttttaatagaaaagtaaattattttagaaatatagaagttagtgtagtgtggaatttggataaaatatgtagagggag

SEQ ID NO: 290 - DNA, 10490 bp, Artificial Sequence
  chemically treated genomic DNA (Homo sapiens)
agaaggtgtttgtttttttttcgttttttgttatgattgtaagttttttgaattgggagtcgattaaattttttttttttataaattatttaggtttaagtatttttttatagtagtgtgaaaataaattaatattttttttttgaggcgttttttttttaggtaattcgttgtttttatgttttttttttgttttttgtttttttttttttttttatgaggtttaagtgataaacggggttagttttagttttagttttagttttagttttattttattgtaggtttgtgtggttgttggagaggtcgtgtttttttttttttttcgagtttgtttgatatgttttttggattttggaggaaattgattttttatttttatattggtgtaatattttttaagattttaaagttgtattatttgagttagtttttttttttatttttatttgttagggttgttattgggatagttttagagggtggtgttaatggatgaatggatggatggatagtagtttagggatgatgtttttgtttgttttgaatcgggttttttttttaatgagaagtttttttgagtgagtatatatagttattttttggtatttatggaggattagttttagggttttcgggaatgttaaaatttatggatgtttaagtttttgatataacgtggtttagtatttacgtataagttatgtatattttttcgtatacgttagatcgttattagattatttatgatgtgtaatataatgtagatgttatataaatggtcgtgatattgtattttttagggaatgatgataagaataaagtttgtatatgtttaatagaaatataatcgtttaatttattttttgaatattttttatttgttgttgttgaatttatagatgtagagtttttggatacgagagttaagtgtgttttgagagtagggtgggtgaggttgttaatgagtataggggagtaggtgttgattaggaggattttgtattggggtatttggacgttttgttttaggatttgagattttagttggatggtataggtagatttagtttaggttaaagtcgtttttttgaagtttttttttattttaagttttttttggattttggaattcggtattttttaggttttgcgtggaaggatagatgaattaggttttagataatatgtttagaagagtgagtttttattgtgtgttcggtattttttttataggattttttagttagaatatttaagggttatggagagaaatatttagttaaaatattagaaaagaaaaagtgatattattagagatattaaaaagattattaggtaatagtattagtttttgtattttgagatttaatagtagtagttatttttttttatcgttatgtgtattttaggattattttgggcggggagggttgcggttagggagtagttatggatgttttgatgttggttttgggtttcgggggtgatagtgatgaggaattgggtgtatatatgagtggggtagtcgggtttggttagagaagtagtatatacgtgtatagacgtgtttatttatatatatatgtgtacgtacgtgtataaatatattgtaggtaggtatgttgacgttttaggtagcggaggattttgattttgggcgttgttgattcgggtaaggttttattgtgattcgtgttatgattttagaatgttattggtgtttagtatttgtttgttttttggtttgttttagtggtttatagtagttatatataggtagtggtatttgtgagtagttttgtggatttaaaggttttttttttgagaggtatgatttaggttagttgatttattagaattaggtgagcgtgatttgtttttttttttttaggcggatttggggatagtggttacggtgcgggcggtgttggtttttgtggggtagttatcgaggagggttatttttgagtatttattaggcgttcgttttatattgttcgtgtagacgattggttttttcgtttttatggtggtttcgtagagtgggtgttgtttttaaatgtttttattcgatagatgagacgtttggggttagagaggtagtaatcggtttgggaattcggatatgattttgagttttgtttttagttttgtcgtgtgttgtgttggaatttaggtttgaattttgtgatttttttgttttagattttaaatttgtttaggttttttatttcgatggggtagagtttggttttggtagagttattggtatagagttattggtatagatttattgacggtttttagaatatttttgtgttttaagttgggttttgatggtcgttgtgggttttattgaatatatatggttttttgtttaggggagtttgttgtttttgggtagttgtggaaaatgaaggagttttggagggttggttgaggggagattatttttttttgtgtttaaaggggttcgggtattagggttttttttaggtattttttgttttgcgtggtttttttgaggtttcgttttttttttgtttcgagtatttttaggagggacggtttatttagttgttttttaggattaaggatttattgtttttttttagtgatttaggaaaatgaagtttttttttgttgggacggtttagaatggtggattttatagttttttcgcgagagacgtggtttttatgcgtataatagattttttttattttttaaatttaatatttttttgtttaataggcgttatttttaaagtggttttattgtttagattgaagagttacggtagttaaagtgatgagcggagtagaatcgagtagtcgggagagattttgttttttgtaggaaattgggtatcgttgaggttttgagtattttaggaggtcgattgtatagagatttttggtcgttgattttagtttgtttttatatttttggaatagtttattatgggttttttatttttggtaggtggaaattatttaatttgttggggtcggtgtgtttttattttatggtattgggggataataggattttttgtttaggttttattgtatttaagtttttgggaagatgtttatttttgtttgggatttgagattttagagattggagtagttgtgggttattgggtttggtttttttttttttgggggcggcggtggaatgggggttacgtagttagttagtatttgggagttcggcgagagcggtttaggtgtttttcgaagtcgtcgcgtatagtgtgatttttagataattttgttttataggatggacgtggtagaggtcgcgggtagttggtgggtataagagcgagaggatattattatgaaatacgaaaaggtataagtcggtttgttttttggagggaggttttttttagtgtgttttggttaaagggttttgggttttttaggagtatagggtagggacgggtggttaatgtttttaggtttttgtattttttattttggattttttattaaggttttttttgggttatagggatatcgagttgggttgttagaggataaggggtttaagttttttcgaagttataataataacgtcgattatttggggattgtatagtgagttttttgtattttttttatttttaaagtatttgttttagtttagggatgggtttgtttttagaaaggtttttttgacgtaggatatgttttattaggtcgggttaattttttttttagggatagaatttttttttgatttttttgtaggtttagttcgaggttgttaggttagaggtgtggggtttatttagggagtcggtgggaatggagattgggttaggttaggtttttgggcgtttagtagttttgtcggtaagtgagtataagaggagcggggtagtttgagggtttggttttgtttatttggagataatttcggtgagatgtaagggttatggttatagggtgaggggacgtttggtttagttttagggttgttgtttagtaggtttttgagggtttatttgtttttgtttttttttatttttttagagttatagtttttattgtttcgtgaggggaaaaggtatggtgataatgggggttgtagttttaggagaacgggggagaagatgggtagggtttcgttttgggtattttacggtgaggttagggaggtagtagggttcgcggttaaagatttgggtttggtgttgggaagggatttggggtcgggtaagaggagtttagttaggagtttattttttagggattataggatggagagatagaggatttttggggaggtagggcgggagggagttgacgagtcgtgttatttttgaaacgtagggtgtgtggttcgggtgtagggagaggtaggtggatgttgggaggttagaatttgtaagggttttggggttgttaagtggggtgggtttttggtgtagttagagtatatcgggtaggttttagggtaggtttttttgattttggcggggggatgtggttattttttgagggatttttgttagggttcggtcgtttattttgggcggtttttattttattttagggttaattttttttagttttagtagaaagtattatttcgagtttaggacgggtagttttattgggtagtttgatcgttttttacgttaggggttttagtaatttcggttaggttgtttttatattttttttttttttaggttttgttttttttgggagttagttttataggaaggtttttgtttttttttttttgtgtttttttttgggttgagttttgagttggaaagggatagagttagttttttttgggggtcggtatttaggttggggtcgttttaggtttcgtgtagttttttagttttgtttgggttgttttatagtgagacggagttgttttttttgattgcgcgggaggcgaaggtaagagtttgatgcgtggaggggttggtttagggacgtagggattgggcgggtggttagtgaggtagaggaagtagttggtttgagcggtggcgggtgagggtaatacgttgttattgggaggggtagtagtttttgttggatttgattttaggttgttgtttattttggtagtttgataaaattttaaaaggagaattatagttttggtttgggggtggttgcgcgtttgtgttaggattttatttagaggttgggatttaagattggtgtgtttgtggtttgaggatggtatatttcggggttttaaagttagtttattggtgtttatttgtttaaaggtttttagtttttgaggtttgtttttttttggttttttttagttggtttttattagggttttagagtttaagatttagtattcgcgggcggttttgggaagtttggtagtttcgttaattttaatatgttttatttgatagtaaattcggcgggagattagtcgaaagagtaagtgggtggatatgttgggagattgggagaaatataaaagtagtagaaaggtaacgtgtggagggaggaagtattttttgtagagataggggataggtatttatggttgtggtttggtattattagttttttagagggtgggcggtatattgttttcgtttagaggattgtaggtttggtcgttagattttttgtttattcgtgtaagcgttattttgtagggagggaatttgaatttagggttgggattattcggagtttaaggttagggatgttttggtgatttgaaggaaggaaaaggtttagattagagtttcgattttgagtgtttatttatttttttagttttgggaagggagattttgttttagtttgattttatttttattgaggaattatggggttaaaatcgataatttttagaattttcgggttttggtttttattggggttatttcgtggtttgtgatattagatcgttttttgtttatagtttatagatcgagcgtataagggaatgtttatgaatattcggggttcgatgtggttagtttttttgaatattgaggaaatgaagttgaaaaatttcggaagatattaggtacgtttagttagagtataataaataggataggtcgtgtcggggtttaggtttttagttggagggaacgttaagattattttggggagttgggggtgaaggttagatgaatattttgggtatagatggtgatatagttattatagataaatttagttttggtgattttttttggttttagtaataagttaaaatgtagttttttgtagaaggaaattttttttttgtttttttttttcgaagtgttgattgtgggttgattgttattgggggtagggagttttttatttgttttgagattgttttttttttttggttttgttttatagattatgaaggagaagggtaagaggttatttgagtatatttagcgtatcgatcgggacgtaagcgggatattaaggaagtatatattttttagggatcgatacggaattaagtaagtttacgggagttatagggttttagtagagatggggtgaatgagagggatgggggttttttcggagtagaagttagggttatttaggagggatgatatagttgttaagagttttttcggtttagggagtagtcggtattatgaatcgagtatttttttggttttaagttttgggttagattggaatatgtggggttagaatttaggaggattttgaggagatggaaggtagtaaataaaattatgtataatggtgaagggtgttttttttgatttatggggatttatggtaggatttacgggagggtggtaggatagagggtttatgagttttttttaggtaatagtgatagtattaaatgttgggagaattaggggttttggaaatttttatttaggttcgttgggaatatgatatggtatagttacgttggtagttcgttgggtagtggtttataaagttcgatggatttgaattatatatttttaaagtgttatagatattgaatttattgatttgtaaattgatatttatatgaaattagtatgttaggtttattgtttgatttttcgttatttatatacggagttttcggggacggtttttaatacggggatggggagagtaaggttggttttttttttaaacggaagatttagtgagaaaagggaacgagtcggtgatgttcgtacgaacgtgggtggattttagatgtattttgttgagggatagaagttagatttaataagttattatagtaggatttttatttttaggttattttggaaaaggttaaattatagggattgagaagtagtttgggtggttaggggttgacggatcggggagaggttgggtgtataggggttattttggagatttggaggatgaaggagtcgttttaggaggggttggagcggtggtcgggagattttgtatattggtttggaatcgtggaggaattgtatatttatagattgaattggcgtgtgtgtaaattgaaaaaaaaaaaaaaaaattatttagagtgaaaaggattaggtaagttattgtataattgggttatttgtatgttatagatgtggattttattgaaatatttttttaagagttttaggttttgaagagtttattgtttatttggtgaaatatttgaatttgaaatgggatttgttgttaggttttgtagataaagtgaaattaataatatttgtataaaataaattaaagttttttttttttgttttttaggtagcgggaattattttatatttttttggtatatgaggagtataattcggtgagtattttcggtagtgaggttttcgggttatatttttatattgataggagtgggtgtttggtgggggtgtcgttgttttttttaaagttagtatttgtgatttattaggatataggaggtaggatgttagtttatcgttggtataaatttttaaggaagggggtggttttaaggggttaagttgagatatagaggagttagggtttggatttttggtgttatttgggtttgattattattttttagaataagaaatgacgttttttttttggggttgttttaaagtttaggagtttggtagtatcgtatataggatggtgttattagtagatattttggataaggtgttgaagtgtttgatggatttggtttttgttatgaaatgaatgtgtattttgaggaagttttttttttagaggaagttttttttttagaggaagtttttttagttatttttgttttttttaatgatatgagtttttttaggtgattttagtttttttaggtgatgtttttttatggtgattttggtttttgtaggaggtgggttattgtagggatttgagttatatcgtcgttttgttttttttttatttttttgaggaggatgtattttgggtattggtgtagttgttggttagtgagaggtattttttgtagggtaagtgaatagttgtttcggggattttttgtagttagatttggggatggttattttggttaggtgattatagtttttagttaaggtattttttttgtgtcgttagtttgttgggagattttaggatgtttttgttgagggttttataggagtttacggttgatttttaaagtttaaattagacgttttttatttttattagtagagggtattttatttttttcgtggttattttttgtgttttggagttacgtttttcggttttgattttgtgtagttgatttttttttttttgagagtttttttgttttttagttgttcgggtttttgttgttatcggtgtttacgaatgggtcgattaagtttaggtggtagtatttttttattttttgttttttggttcgattttattattaggagatgatcgggaagtttagcgtttatttagtttcggttattttgtcgtggtttgaaagttaggtttgttttttttgtattttggtttaggaggtttttaggggaatttttagttaggttttagggaatgttttcgttttatttttttagggtaaaggtcgtatgttggggttattagatgggagggtgggaggttttggggtttgggggtttttttagttgtttagtttttgtagttgatggttttatattttgggggaaggttttgattttatgatgggttgggggttttttaggattttatagtttaaatggcgggatcgtttaggggttttaagattaataggagtatgtggtagttacgttataatttaagattatggggtattaggtgagtttatggtttttttagttttttttagaggttttgtttttcgtggggttgtaggagtaggggggttggagtttttcgtggggttggtgattggttgagttttagttagggtttgatttgggacgtcgggttttttatgggttgggagttggtttttttttttgttttggaggagatagaggtatagggatgggggtttagttttcgtagagtagggtaaagggtagtgtgtttatcgggagtgtgggaaggtgatagtgttgtggggagttttggatatcgtttagtgttttgtattaggggaagggtttttagaggttttggaagagggaggtttttagggtagtttagtggtttgagtatttttgttgtttttattaggataagaaagatttatgtgggtagtgtttttcgttaggttgttttattcggatattgattgacggggtaaggaggtatagggagattttggtttagggattttttttgttttgtagtgttttgtttttttagttcgggggtttggtttatttttagtttataggaggtttaggcgggtttttaaaggatatataagtaaaattttttgtttaaggggggttattttagggttatggttggggtttaggtttagttttatgggtagattgggttaggattcgatttgagagggtttagggaagttttaagttttgggtaagtttttttttttaggagttatatttttatttaaatgagtgttttttatgaggagttttaagattttgtttgatttagcgttttggagggtttaggcgatttttatggggaaggttattgattttggagattgaagttttagtgtgcgtagttcgagttattagttttagtttggaaggattaggtttttttatatttgttgtttttatagatttttttcgggtttattttgcgtttgtgggacgtgtatttggtagaaggcgaataggcgttgatgtcgataataagaatcgtttttaaggtttagtagagtaagtttacgtgtgtttagcggggtttggggagttttggggttagatttcgattggttcgagggtagtttttttatattgtttttatgattttttgttttggtttagagggaggtttggttaggtgggttgggtaggatattgtgatatcgagtttattttttatatgatttagatgaaagtcgagagtgtggtgagtatttttttgttt

SEQ ID NO: 291 - DNA, 10490 bp, Artificial Sequence
  chemically treated genomic DNA (Homo sapiens)
ggatagggaagtgtttattatattttcgatttttatttgggttatgtgggggatgggttcggtgttatagtgttttgtttagtttatttggttagatttttttttgggttagaatagaggattatgaggatagtgtgaggaagttgttttcgggttagtcggggtttgattttagggttttttaggtttcgttgggtatacgtagatttattttgttgaattttaaaggcgatttttgttatcggtattaacgtttgttcgttttttattagatatacgttttataggcgtagggtgagttcgagagagatttgtggggatagtaggtgtgaaagaatttggtttttttaggttggggttggtggttcgagttgcgtatattggggttttagtttttagagttagtgattttttttatgagggtcgtttgagttttttaggacgttgggttagataaggttttgaagttttttatggggggtatttatttgagtggggatgtggtttttggagagaggggtttgtttagggtttgaggtttttttgagtttttttaagtcgggttttggtttagtttgtttatgaggttgggtttgagttttagttatggttttgggatgattttttttgggtagagggttttgtttgtgtgttttttggggattcgtttgagttttttgtgggttgggagtgagttagattttcgggttggggaagtagggtattgtagggtaaggaaggtttttgagttagggtttttttatgtttttttatttcgttaattaatattcggatgaggtagtttaacggggaatattgtttatatagattttttttgttttgatggaagtaatagaggtgtttaggttattgggttgttttaaaaattttttttttttagggtttttgaagattttttttttagtgtagaatattgggcggtgtttagagttttttataatattgttatttttttatattttcggtggatatattgttttttgttttgttttgcgggagttgggtttttatttttgtgtttttgttttttttagggtaggaaaggaaattaatttttagtttatggagaattcgacgttttaggttaggttttggttgggatttagttagttattagttttacgaggggttttagtttttttgtttttatagttttacgggaggtagggtttttgggaagagttgaggggattataaatttatttgatgttttatggttttgggttgtgacgtggttattatatgtttttgttggttttggagtttttggacggtttcgttatttgggttgtgaaattttgagaagtttttagtttattatgaaattagagtttttttttaagatgtggagttattagttgtaagagttgggtagttggagaggtttttaaattttaaggttttttatttttttatttggtgattttaatatgcggtttttattttggggaggtggggcgggaatattttttggagtttggttggaggtttttttggaggttttttgggttagggtgtaaaaagggtaagtttgatttttaggttacgatagggtggtcggaattgggtgggcgttgggtttttcggttattttttggtagtggggtcgggttagggaataggggatggggagatgttgttatttgggtttggtcggtttattcgtgggtatcgatggtagtaggagttcgggtagttggagggtaggaggatttttagggaggggagagttagttgtatagaattagagtcggagggcgtggttttaggatatagagggtggttacggggaggatgagatgttttttgttgatggggatgagaggcgtttgatttgggttttgggggttagtcgtggatttttgtgggatttttagtagagatattttaaagttttttaataagttggcgatataaggagggtgttttggttgaaagttgtgattatttggttagggtggttatttttaggtttggttgtaggaggttttcggggtagttgtttatttattttgtagggagtgttttttattggttagtagttgtattagtgtttagaatgtattttttttaggaagatagaggaggaataaggcggcgatgtggtttaggtttttgtagtagtttattttttgtaagagttagagttattatggaaggatattatttgggagggttgaggttatttgggaggatttatgttattggagagggtagaggtgattggagaggttttttttgaaggagaggttttttttgaaaaagaggtttttttaggatgtatatttattttatgataagagttaagtttattaggtattttagtattttgtttaaaatgtttgttgatagtattattttgtgtgcgatgttgttaagtttttgggttttggggtagttttaggaggagggcgttattttttgttttgagaagtggtggttaggtttaggtgatattaggagtttaggttttgatttttttgtgttttagtttgattttttgagattatttttttttttggaggtttatgttagcggtgagttgatattttattttttatattttggtgggttataaatattaattttaaaagaagtaacgatatttttattagatatttatttttgttaatatggaaatatggttcgggaattttattgtcgggaatatttatcgggttgtattttttatatgttaggaggatgtggagtagttttcgttgtttaggaaatagagaaagggggttttggtttgttttgtgtagatgttgttaattttattttgtttataaagtttaatagtaaattttattttaggtttagatgttttattagataagtagtgagttttttagggtttgagatttttgaagaaatgttttagtaaaatttatatttgtgatatgtaaatagtttagttgtatagtgatttgtttgattttttttattttgaatgattttttttttttttttttagtttgtatatacgttagtttagtttgtgggtgtatagtttttttacggttttaaattaatgtgtagagtttttcggttatcgttttagttttttttggggcgatttttttattttttaagtttttagggtggtttttatgtatttagttttttttcgattcgttagtttttggttatttagattgttttttagtttttgtggtttggttttttttagaatggtttaggaatgggaattttattgtggtagtttattgggtttggtttttgttttttagtaaaatgtatttaggatttatttacgttcgtgcgggtattatcggttcgttttttttttttattgggtttttcgtttgaagggaggattagttttgttttttttattttcgtgttgaaggtcgttttcgaaggtttcgtgtgtgagtgacgaggagttaagtagtgaatttggtatgttggttttatgtggatgttagtttgtaaattagtgggtttaatatttgtgatattttggggatgtgtggtttaagtttatcgagttttgtgagttattgtttaacgggttgttaacgtggttgtgttatgttatgtttttagcggatttggatgagagtttttaggatttttaatttttttagtatttggtgttgttattgttgtttggggggggtttatgggttttttattttgttattttttcgtgggttttattatgggtttttatgggttagggagagtattttttattattgtgtatgattttgtttgttgttttttatttttttaggatttttttgggttttggttttatatgttttagtttggtttagggtttggaattagggaggtgttcggtttatggtgtcggttgttttttgggtcgggagagtttttggtagttgtgttattttttttgggtgattttggtttttgtttcggggaagtttttattttttttatttattttatttttgttgggattttgtggttttcgtaggtttatttggtttcgtatcgatttttgaagaatatatgtttttttaatgtttcgtttacgtttcggtcgatgcgttggatgtgtttagatgattttttgttttttttttttatgatttgtagggtagggttaagaggaggaagtagttttagaatagatggaagattttttgtttttagtggtagttagtttatagttagtatttcgggaaggaaggatagaaggaaggtttttttttgtagaaagttgtattttggtttgttattgaagttagggagggttattagagttgagtttgtttgtggtgattgtgttattatttgtgtttagggtgtttatttgatttttatttttagttttttagggtggttttgacgttttttttagttggagatttgggtttcgatacggtttgttttgtttgttgtgttttggttgagcgtatttggtatttttcggggttttttaattttatttttttaatgtttaggaggattgattatatcgggtttcggatgtttatgggtatttttttgtacgttcgatttatgagttgtgggtagaaaacgatttggtgttataggttacggggtgattttagtgaggattagagttcggggattttggaaattgtcggttttggttttatgattttttagtagaggtgagattaagttgggatagggtttttttttttaggattgaaagagtggatggatatttagagtcgaaattttgatttgaatttttttttttttttaggttattagggtatttttagttttgagtttcgggtagttttagttttagatttagattttttttttgtaaggtgacgtttgtacgaataggtaggaaatttggcgattaggtttgtagttttttgggcgaggatagtgtgtcgtttattttttgagaggttgatggtgttaggttatagttatgggtgtttgttttttgtttttgtagagagtgttttttttttttatacgttatttttttgttgtttttgtattttttttagttttttagtatatttatttatttgttttttcggttgatttttcgtcgaatttgttgttaaatgaggtatgttggagttagcggagttgttaggttttttagagtcgttcgcggatgttgggttttgggttttggagttttggtgggagttagttggaaggagttagggaagggtagattttaagggttgagagtttttgagtaaatgagtattagtgggttggttttgggatttcgggatgtattatttttaggttatagatatattagttttaggttttagtttttaggtggggttttgatataagcgcgtagttatttttaagttaggattgtggttttttttttggaattttattaaattgttaaagtgaatagtaatttggggttaggtttagtagggattgttgttttttttagtgatagcgtgttgtttttattcgttatcgtttaggttagttgttttttttgttttattgattattcgtttagtttttacgtttttggattagtttttttacgtattaggtttttattttcgtttttcgcgtagttagaggaggtagtttcgttttattgtaaggtaatttaggtagagttgaggaattgtacggggtttggagcggttttagtttgggtgtcgatttttagaaaggattggttttgtttttttttagtttagggtttagtttaggagaaggtatagggaagggaggataagggtttttttgtggggttgatttttaggaggggtaggatttgggagaagaaggagtgtagggatagtttggtcggggttattggggtttttggcgtggggggcggttaggttgtttagtggggttgttcgttttggattcgaggtggtgttttttgttggagttgagaaaggttagttttgagatgggatgggggtcgtttagggtgggcgatcgggttttgataggagttttttagggagtgattatattttttcgttagggttaagggagtttgttttgagatttgttcggtgtattttggttgtattaggggtttattttatttgatagttttaaggtttttgtaggttttgattttttagtatttatttgtttttttttgtattcgagttatatattttgcgttttagaagtggtacggttcgttagttttttttcgttttatttttttagggattttttgtttttttattttgtgatttttgagggatgggtttttggttgggttttttttattcggttttagatttttttttagtattagatttaggtttttagtcgcgagttttgttgtttttttggttttatcgtgagatgtttagaacggggttttgtttattttttttttcgtttttttagggttatagtttttattgttattatgttttttttttttacgggatagtgagggttgtagttttaggggaatgggggagaataggggtaggtgggtttttagagatttgttggataatagttttgaggttgggttaggcgtttttttattttgtggttataatttttgtattttatcggggttgtttttaagtagatagggttagatttttaggttgtttcgttttttttgtgtttatttgtcgatagaattgttgagcgtttaggggtttgatttagtttagtttttatttttatcggttttttagatgggttttatatttttggtttaataatttcgggttggatttgtaggggagttagggaggagttttgtttttggaaaggaggttgattcgatttggtgagatatgttttgcgttagaaaggtttttttaaaagtaaatttatttttgagttgagataggtgttttaggggtgaggggagtgtagaggatttattgtataatttttaaatgatcgacgttgttgttgtagtttcgaaaaggtttaggttttttgttttttggtagtttagttcggtgtttttgtagtttagagggagttttggtgaggggtttaaggtaaagggtgtaagggtttgggggtattggttattcgtttttgttttgtgtttttagggagtttaggattttttgattagggtatattggaagaggtttttttttaagaagtagatcgatttgtattttttcgtattttataatgatgttttttcgtttttgtgtttattaattgttcgcgatttttattacgtttattttgtgagatagaattgtttaaaggttatattgtacgcggcggtttcggagaatatttgaatcgttttcgtcgggtttttagatgttggttggttgcgtaatttttattttatcgtcgtttttagggaaaaaggggttagatttagtggtttatagttgttttagtttttggagttttaagttttaagtaggggtgggtatttttttaaggatttgagtatagtgggatttagatagagaattttgttgttttttaatgttatgaaatggggatatatcggttttagtaggttgaatggtttttatttgttaagggtgaagggtttatgatgggttattttagggatgtggaggtagattggggttagcgattagaggtttttgtgtaatcggttttttgggatgtttagggttttagcgatgtttagttttttatagggaataagatttttttcgattgttcggttttatttcgtttattattttggttatcgtggttttttagtttgaatagtgaagttattttaggaataacgtttgttgagtaggagggtgttgggtttgggggatgagaaagatttattgtacgtatggaaattacgtttttcgcggagggattgtggagtttattattttgagtcgttttaataggaggaggttttatttttttgggttattgaggaagaatagtgggtttttggttttggagaatagttggatggatcgttttttttgggaatattcgaggtaaaaggagggcgaggttttaagaggattacgtagagtaagaaatatttggggagaattttagtgttcggatttttttgaatataagggaagatagtttttttttagttagttttttagggtttttttattttttatagttgtttaagggtagtaggtttttttggataagggattatgtgtgtttagtggggtttatagcgattattaggatttagtttagggtatagaggtgttttgaggatcgttagtggatttgtattagtggttttatattagtggttttgttaggattaggttttgttttatcgggatgggaaatttgggtagatttgggatttagggtagggaggttatagggtttaggtttgaattttagtatagtatacggtagggttgagagtaaaatttagggttatgttcggatttttaggtcggttattgtttttttgattttagacgttttatttgtcgaatggggatatttgggaatagtatttattttacgaagttattatggagacgaaagagttaatcgtttatacgggtagtgtagaacgggcgtttggtgagtgtttagggatgatttttttcggtagttgttttatagaggttaatatcgttcgtatcgtagttattgtttttaagttcgtttggagggaagagagtaggttacgtttatttgattttgatgaattagttggtttgggttatgttttttagggagaaaatttttgagtttatagagttgtttatagatattattgtttgtgtgtaattgttgtagattattgaggtaggttagagagtagataggtgttaagtattagtgatattttgaggttatggtacgaattatagtggggttttgttcgggttagtagcgtttagagttagggtttttcgttgtttgaggcgttaatatgtttgtttgtaatgtgtttgtgtacgtgcgtgtatatgtgtatgtgggtaaatacgtttgtgtacgtgtgtgttgtttttttggttaggttcggttgttttatttatgtgtgtatttagttttttattattgttattttcgaggtttagggttagtattagagtatttatggttgttttttaatcgtagtttttttcgtttagggtggttttgggatatatatagcggtggagggaagtgattgttgttattggattttagaatataaaagttaatattattatttaatggtttttttagtgtttttaatggtattatttttttttttttgatattttaattgggtatttttttttatgatttttggatattttagttagaggattttgtggggaaagtgtcgggtatatagtaggggtttatttttttagatatgttatttaaaatttggtttatttgtttttttacgtagggtttaggggatgtcgaattttagggtttagaaagagtttgggataaaaagaaattttaaggggacggttttgatttgggttgagtttatttgtgttatttaattggagttttaagttttgaggtaggacgtttagatgttttagtgtagggtttttttgattaatatttgtttttttgtatttattagtaattttatttattttatttttaaagtatatttggttttcgtatttaggagttttgtatttgtagatttagtaatagtagatggaaaatatttagaaaataaattggacggttatgtttttattgaatatgtgtagattttgtttttgttattattttttaaagaatatagtattacgattatttatgtagtatttgtattgtattatatattataaataatttagtaacggtttaacgtatacgggaggatgtgtatagtttatacgtaaatattaggttacgttatattagagatttgagtatttatggattttggtattttcggggattttagaattaattttttatggatattaagggatgattgtatatatttatttaggaaggttttttattggaggaaaggttcggtttaggatagatagggatattatttttggattattgtttatttatttatttatttattggtattattttttaggattgttttaatgatagttttagtaagtggagataagaaaaaagattggtttaaatggtatagttttgaggttttggaagatgttgtattagtatgagaatagggggttagttttttttaggatttagaaagtatattaggtaggttcggggagaggaaaggaatacggtttttttagtagttatataggtttgtagtaggatggggttggggttggggttgggattggggttggtttcgtttattatttgggttttatgaggggaaaagaaagaatagggggtagaggaggagtatgggggtagcgggttgtttaaggagaaggcgttttagggaaggggtattagtttgtttttatattgttataaagaaatatttgagtttaggtaatttataaaggaaagaggtttaatcgatttttagtttagggaatttatagttatggtagaaggcgaaggggaagtaggtatttttt

SEQ ID NO: 292 - DNA, 6416 bp, Artificial Sequence
  chemically treated genomic DNA (Homo sapiens)
ttttcgatttatttgtgattgagggtaagaatgttttttttttagagattcggtgtttttttttgtaaaatgaggtttattttgtttttttttaagggttttagggaaattttagttagagtagtgaggtgttaggtaaattttgaggggtattttaatcgtcgtgtgaggttaggaggtttgaatttttttattttttttttttaggataagggtatataattggtttcgttaagttttttttttgtttagacgttatggagttggatttgtttttattttattttagtagtttttcggaagatttttgtttagtttttgggattttttttgggatttttcggttttttgatatttttttgtttgaggaggtaaagaggttttagtttttttttattttaattatcggtaggtacgatggggcgtggggtttgggggaggttagtgttggataatatatagaggtttgtaggttattgtttttttttttatatttttttttttttttttttttgttataggaaatttcgagaggaggagaggcgtgttattttttttttttttatttttaattttttttttgagttttgtagtttttttttatagagtttaattttcgggggtttttttagtgtaagggggttgttttttcgcgatgttagtcgtttttatgtgagttgttttttagaagggaagggagggatgtacgggttttgggtttgtgggagatatatagtcgtttttatggaggtaggggattttggttaggagtttttgagggtttagtaggtgcggaaagggaatgaattattttttgtttttttttaagtcgtgtgtaatttttggggcgtaggtagtaaaggtgtatagtgaggatggggtttgtaggtttgtggaggtggtagtaggtgttatagttcgttacgtgtgtgaaatgttggtgtagcgagtttacgttttgagcgacgagatttgggggttggtggagtgttatttttatttagtattgggtaagttaggtgtatggaattattcgggttgggagatgatgttttgtattttgggttaggtatgtggtttatttaggagatttggttgatttttaataatttttgttttttgtttttgtttttagagcggggtttggaggattacgagttcgtggtggaagtgtaggttgtttggttcgtgggcggagatagtcgtttcgtttttcggaaaaatttcgttaagtacgaattgtttaagagttttttagtgagtgtatgagggttgtttgggcgttgggatgttttgatttttaatttggatgttggagttttgatttttgatatttgtttatttatagtattttttgtttttagaaaaaatggtttttagttgtttcgatgtatatattggtatattttatgaagattttatttaggtggggggattttttattttattgtagatttacgattttttagtattggttagtgtttttttatttttaagttttgtgttttttttttatgttgtagaaagagttaaattatagttttgtgtgattggggatagttattttttttgtttgagtattagttttttttattaaatgggggcgagaaatgtatgtggagtatttttttgtaaaaatttgagggtgggttgggtacggtggtttatgtttataattttagtattttgggaggttgaggcgggaggattatttaagtttagaagtttgagagtttgagattagtttgggtaatataatgagatttcgtttttttaaaaaaaaaaaaaaaaaaaaaaaaaaggttaggaatggtggtatgagtttgtagttttaggtgtttgggaggttgaggtgggaggattatttgagttcgggaggtcgaggttgtagtgagttgtgatcgtgttatcgtattagtatgagattttgttttaaaaagaaaaagaaaaagagaaatattttggtggtagaggggaagggaggaggttagatttgttatttttttttgtttttttttggtttagaattttttgaatgttggtagtttttttgagatttagggttttttgtagttgcggggtttaggacggaagttttggaaacgttttttttgttttttgcgtcgatttggtttttattattttattaagggtatttttaaggtaaggttttgagggtattagttttagtttttttagtttttggtttttttagaagttgttttttttttgttggaatttttgagtttttttttttttgggttttttaggttagttatttttagtttattatttttttttatatttttgtttagtttatttgtttagggaggtagtaggagaaaagatgattttagtttaagttttggttttatttttatttgttgtgtgattttgggtatttttttgtttttttttggttttgaaatttttttatttggtttgtggggggaggtaatagtgggcgggatttatttgtattaagttttgtttatttatgttgtttaggattcgaggtatttgtagtacgtggtagatgtgaacgagtttaacgtgtacgtggtgacgtagggtcgtaagttttacgggatgtttattgatttcggtttttgtgttaaggtgaagatttggttaggtttggtttttggtttggggaagtaggaattgtttaggtttttggattttgttcggggtttttgagttttaatttagatatttagatttttttttttgtattttggtttgttggaaatttttggatttagttttgttatgtggagtaggggtagatatgtggttttaaaggtagatatgggattagttaattttttttttttgtagtttaataagtttcgaaatggttataaggggtttcggattttttgtagtgaagatgagtagagtcgtatttgttggttggttgtttttcgtttttttaaggtgagattttgggagtggtatggggggttggtttggttagagggatttttagttttgtttttaggaagttttaggaatgaggagggtattatagttttgttttttgataatttttagtttaagtttgaagttataggaagtgtttatcgaaggtagaaatatagttttggtttgggtaagttttggtttgaggggggcgttatagttacgtttttaggatttttcgattttaagttttttttttttttttatttttagtacggggtgtagttgtataagaattattagtaggtatagtttcgttatttgtatttattttgtttgggttttttatttttggtgagtgtgtttaaggggatgggagggtgggtatgtaggttttgttttacgggtatttgggttttgttttgattttttttttttttttttatttttagagaagtgttttagataatattttggtggttatggatttttttggttatgttgggcgtgttattgagaattttcgggaggttttgagtgtggttttggaggaggtttaggtttggagggtgaggtttgttgtgtgtgtgtgtgtttgtgttggggatttattttttgggtgggatttttgaaataggagggaggaagagagggcggggggaggtttttggttgggaagaagtgttttatttttttgaggtgttgggtaatgtttttaagtacgtttcgattttttcgtattttttattgttttatagaagaagataaattatcgttttagtttgtttatgttagttttcggtacgagttttagtgtaggtgggtgacggtttcgagttttggggcgggggttgttttaatttttttttgtatttttagtggggagtagatggtataggggttttttttttaaagtgatcgtttatgtttttttttattatagttatttatcgtatttaattttggttttacgggcgtatttttcgtgaggagagttagcggtttattggatagtagggtttggtagacgggtaaggggtagggtcgggtaatagatttagggataagagagattggggtttaggtggtagttatggtttttgggtagtaatgttgttttattttttgttttttggtagtttgtttttggttcgggagagttagcggaatttttagggttttgttttttttttgtgttatttgtagaaagtgaagtattattttattttgtcggtgagtttttttgcgttttcggagttttgtaatgagatataggatttttagtaatttgttttttttattaggtttttttagaggttttttggtttttagtgcgttttttttttttttgtataagaagtgggaggttgagtgcggtggtttatatttgtaattttagtatttaggacggttaaggtgggagaatggtttgagtttaggagttcgagattagtttgggtaatatagggagattttatttttataaataatttaaaaatgagttaggtatggtggtgtatatttgtagtttagttatttaggaggttgaggtgggagtattgtttgagtttagagggttaaggttgtagtgagttatggtggtattattatattttagtttggatgatatagtgagaaaattgttttaaaaaaaaaaaaagaaagaaaaagaaaaagaaaaaagaaaagaataaaaggaaatggtggggttttggtttaggagggagttttttaagtttcgggtttttttttgaatttttattttttttattgtattttagagcgaggaggagggtcgtttgtattttagtatggatgatggttagattcgttttattgatttgttgtagttcgtggagttttattagttgaatcgcggtattttgtcgtgtttgttgcgttattgttgtacgcgggtggttttttgattaggtcgtggattggtttatgttttagttcgtttttaggttgttcgtcgtttttttatttatttagtggattttggggcgcggttataggggacgggatgaggagcgggagggtttcgttattttagtttttttttttgtttttttgttttttttagatagaaaatagtttttattttagtttatttttgatttttttttttaagggaaggttttgggtggtttttttttttttttttagttttggaggtgttgttttagggtagggaattatgggagaagtgggggtagtttaggcggttttacgttttatattttgtatagatcgagaggttagttgatttgttttgttttatattagtgataataaagattattttttgatatatttatgagttttgtttggtaaggtttggttggttgaattaagaagggaattagagttggacgtggtggtttatgtttgtaattttagtattttgggaggttaaggtaggagaattgtttgagtttaggagtttgagattagtttgggtaatatggtaagattttgtttttataaaaaataaaaaaatgagtcgggtatggtggtgtgtatttgtagttttagttttttaggaggttgaggtgggaggattttttgttttttgagtttgggatgttaaggttgtagtgaattgagattgtgtcgttgtatttagtttgagtgatagagtgagattttgtttggaaaaaaaaagaggggagatttggagaggtgggtatttgtggaggttttggtggaagtgttaaatggatcgaggttatgttttagtttgtttggatgttttttaagggtaggagtggttatttgagagtttttagtgtttattatgtagtttgatatatagtaggcgtttagttattgttaattaagtaagtgaatagataagagattattattttagagagattttttgatagtttaagtttagagaggtaattaatagggtttgggagttggagatgagttcgatagtatgtttgtttttcgttagttttggattagttgacggatagttggttttagtatgtatatagttatgtatttagttttattattaagatatagaatggttttattatttttaataagtttttgtgttttttattattagttatgtttttttttatttaaattgaaattttttttttgttttagttttgttttttttagaaagttatataaatggagtttgttagtatttagttttttgtatttggtttttatttttaatatattttttagtatttagagtgatttttttttaaatataaatttattattttcggtagggtattgtggtttatatttgtaattttagtattttgggaggtcgaggcgggcggattacgaggttaggagtttgagattagtttggttaatatggtaaaattttatttttattaaaaatataaaaattagttgggtatggtggcgggtatttgtaattttagttattagggaggttgaggtaggagaatagtttgaatcggggaggtagaggttgtagtgagttaaga

SEQ ID NO: 293 - DNA, 6416 bp, Artificial Sequence
  chemically treated genomic DNA (Homo sapiens)
ttttggtttattgtaatttttgttttttcggtttaagttatttttttgttttagtttttttagtagttgggattataggtgttcgttattatgtttagttaatttttgtatttttagtagagatggggttttgttatgttggttaggttggttttaaatttttgatttcgtgattcgttcgtttcggttttttaaagtgttgggattataggtgtgagttatagtgttttgtcgggagtggtgaatttatatttgagaaaagattattttgggtgttgaaggatgtgttggagatggaagttagatgtagagggttgaatgttagtaggttttatttatatggttttttggaaggggtagaattaggatagaaaggaggttttagtttgggtaggagggagtatggttgatagtagggggtatagggatttgttgggggtgatgaggttattttgtgttttggtggtggggttggatgtataattgtgtgtatgttggggttaattattcgttagttagtttaggattagcggaggataagtatgttgtcggatttatttttaatttttaggttttgttaattatttttttagatttagattgttagaaaatttttttgggatgatggttttttgtttatttatttatttaattagtaatgattgggcgtttattatgtgttaagttgtatggtgggtattggagatttttagataattatttttgtttttgaggaatatttaggtaggttgagatatggtttcgatttatttgatatttttattaaggtttttataggtgtttatttttttaggttttttttttttttttttttagatagggttttattttgttatttaggttgagtgtagcggtataattttagtttattgtaattttgatattttaggtttaaggaataagggatttttttattttagttttttgagaagttgggattataggtgtatattattatgttcggtttatttttttattttttgtagggatagggttttgttatgttgtttaggttggttttaaatttttggatttaagtaatttttttattttggttttttaaagtgttgggattataggtatgagttattacgtttagttttggttttttttttgatttagttagttaggttttgttagatagaatttataggtgtattaaaaaataatttttattgttattagtataaaatagagtagattaattggtttttcggtttgtataaagtgtggggcgtgaaatcgtttgggttgtttttattttttttataattttttgttttagagtagtatttttagagttaggagaaggagagggggttatttaaggtttttttttgaggagaggggttaggagtggattggagtgggggttgttttttatttgagggaggtaaagaagtagaggagaaaattggagtggcggaattttttcgttttttatttcgttttttgtggtcgcgttttagagtttattggatgggtggaggggcggcgggtagtttgaaggcgggttgaggtatgagttagtttacggtttggttagagggttattcgcgtgtagtaatggcgtagtaagtacggtaggatgtcgcggtttagttggtggaattttacgagttgtagtaggttagtgaagcgggtttggttattatttatgttgaagtataggcggttttttttttcgttttggggtatagtaaagggggtggaagtttagggaggggttcgaggtttgggaagtttttttttgggttagggttttattatttttttttattttttttttttttttttttttttttttttttttttttttttttgagatagtttttttattgtgttatttaggttggagtgtggtggtgttattatggtttattgtagttttgattttttgggtttaagtaatgtttttattttagttttttgagtagttggattataggtgtgtattattatgtttggtttatttttaaattatttgtagagatggggtttttttgtgttgtttaggttggtttcgaatttttgggtttaagttatttttttattttggtcgttttaagtgttgggattataggtgtgagttatcgtatttagttttttattttttgtgtagggaaaagggagacgtattgggggttagggagtttttggaggggtttggtgaggaggataggttgttgggagttttgtgttttattgtaggatttcggggacgtagggaagtttatcggtaggatgagataatgttttattttttgtaggtggtataaagagaggataaagttttgggggtttcgttgattttttcggattaggaataggttgttagaagataggagatggggtagtattattatttaaggattatggttgttatttggattttagttttttttatttttgggtttgttgttcggttttgttttttattcgtttattaagttttgttgtttaataagtcgttggttttttttacgggaaatgcgttcgtggaattagagttgggtgcggtggatggttgtggtggggaaggatatgggcggttattttggggaggggatttttatattatttattttttattgggaatataaagagaagttgaggtagttttcgttttaggattcggggtcgttatttatttgtattgaggttcgtgtcggaggttggtatgggtaggttgaggcggtggtttgtttttttttgtggagtagtgggagatacgggagagtcggggcgtgtttgggggtattatttagtattttaggaaggtagagtatttttttttagttaggggttttttttcgtttttttttttttttttttattttagggattttatttagagagtgggtttttagtataaatatatatatatatagtaggttttattttttaggtttgggttttttttagggttatatttagagtttttcgggggtttttaatgatacgtttagtatggttagagaagtttatggttattagggtattatttgaggtatttttttggagatggaaggagaggagagaggttagaatagggtttaggtattcgtaagatagggtttgtatatttatttttttatttttttgggtatatttattaagggtggggagtttaaataagatggatgtagatggcgagattgtgtttgttggtaatttttgtatagttgtatttcgtattgggggtggggagagaaagagagtttgaggtcgagaggttttgggggcgtggttgtgacgttttttttagattaggatttgtttagattagggttgtgtttttgttttcgatgggtattttttataattttaggtttggattgggggttattagagagtaaggttgtgatgttttttttatttttgagattttttgagggtagagttggggatttttttggttaggttagttttttatgttatttttagggttttattttgaagaggcggaaggtagttagttagtaggtgcggttttgtttatttttattgtagaagattcgaagttttttgtggttatttcgaagtttgttgggttgtagagagaggaaattgattggttttatatttgtttttaggattatatgtttgtttttgttttatatagtagagttgaatttaggagtttttagtaggttagggtgtagggagaggagtttaggtgtttgaattggggtttagaagtttcgggtaggatttaggggtttgagtagtttttgtttttttaggttaggggttaggtttggttaggtttttattttgatatagaaatcgaagttagtgggtatttcgtagagtttgcggttttgcgttattacgtatacgttggattcgtttatatttgttacgtattgtaggtgtttcggattttaagtagtatgagtgagtaggatttggtataggtagatttcgtttattattatttttttttataagttaggtggggagattttaggattagagaggggtaggggaatatttagggttatatagtaaatagaagtagagttaggatttaaattaagattatttttttttttgttatttttttgggtaggtgagttaggtaaggatgtagggagagatggtaaattggaggtggttggtttggggggtttagggggagaagggtttagaggttttagtagagaaggggtaatttttaaaaggattagggattggaggggttggggttggtatttttaagattttattttagaggtgtttttggtggagtaatagaggttagatcggcgtaagaagtagaaaaagcgtttttaaagttttcgttttgaatttcgtagttgtagaaagttttggattttaggaaagttgttagtatttaggaagttttgagttagaggagagtagaggagagtgataggtttgattttttttttttttttttattattaggatgtttttttttttttttttttttttgagatagggttttatgttagtgcggtggtacgattatagtttattgtaatttcgatttttcgagtttaagtgatttttttattttagttttttaagtatttgggattataggtttatgttattatttttggttttttttttttttttttttttttttttggagagacgaggttttattatgttgtttaggttggttttaaatttttaaatttttaggtttaagtaattttttcgttttagttttttaaagtgttgggattataggtatgagttatcgtgtttagtttatttttaggtttttataaggaaatgttttatatgtatttttcgtttttatttaatagaagaaattgatgtttaggtagggaaagtgattgtttttagttatataggattgtgatttggttttttttataatatagaggggaggtataggatttaagggtggagaagtattggttaatgttggggagtcgtgaatttgtagtgaaatggggggtttttttatttggatgaggtttttatgggatatattagtgtgtgtatcgagatagttggagattattttttttgggaatagggagtgttgtgggtagataagtgttagggattagggttttagtatttaggttgaggattagggtattttagcgtttagatagtttttatgtatttattggggagtttttgaatagttcgtatttggcgaagttttttcggaagacgaagcggttattttcgtttacgggttaggtagtttgtatttttattacggattcgtggttttttaaatttcgttttggggataagggtaaaaagtaggggttattggagattaattagattttttggatgagttatatgtttagtttaagatgtaaggtattattttttagttcggatagttttatgtatttgatttatttagtgttaggtgggggtggtattttattagtttttaggtttcgtcgtttaaggcgtgagttcgttgtattagtattttatatacgtggcgagttgtggtatttgttgttatttttatagatttgtaggttttatttttattgtatatttttattatttgcgttttaggaattgtatacgatttgaggggaggtaaagggtgatttatttttttttcgtatttgttagatttttagggatttttaattaagattttttgtttttatggaagcggttgtgtattttttatagatttagaattcgtgtatttttttttttttttttgagggataatttatatgggggcggttggtatcgcgggggagtagtttttttgtattggaggggttttcgagaattgggttttgtgagggaggattgtagagtttagggaaggggttggggatagaggggagggaggtggtacgtttttttttttttcgaagttttttgtggtaagaagaaaaagggagagaggtgtggggaagggagtagtggtttgtaagtttttgtgtattatttagtattgattttttttaagttttacgttttatcgtatttgtcggtggttgggatgaggagaggttgggatttttttatttttttaggtagaggggtattagggggtcggggagttttaggaggggttttaggggttgggtaaaggtttttcggagagttgttaagatgaggtggagatagatttagttttatggcgtttgagtaagagaggggtttaacggaattagttgtgtgtttttgttttggggagaggggatgagagaatttagattttttgattttatacggcggttagggtgttttttagagtttatttagtattttattgttttaattggagtttttttgaagtttttggggaaggatagaatgagttttattttataaaaggggatatcgagtttttgagaagaaagtatttttgtttttagttataggtgagtcgggag

SEQ ID NO: 294 - DNA, 6001 bp, Artificial Sequence
  chemically treated genomic DNA (Homo sapiens)
ttttaatattagaaggaataaattttgaatatattatttttaagaattgtaatatttatcgtgagggtttacggttttatttttgaagttagtgagattaagaatttattaattttggatataaggtgataggttgagggcggtggttcggttttgggtttttttggggtttttttagggaatgttttggtatttgtcgattgagttttgggaggtagttttggtatatagttttttgatatgatttgttttttattttggggtgttatatatgaagggaggtgattgttgtgatggtgttggtaggattgttgtttttgatgtggggtgggttgagttaggtttgaaatatgggtttttaggttgagttttgttttttttattatatttagggttgattgatatttttagttagtttattttggttttttttttatatgttaggataatgtagtttttgttattaatttgggtagttagagttgggttagtgggggatatgggattatgggtaagggtaattgatatttgtttagttttaacgtattcgttttaaatgcggttaggcggtggggtaagtaggaatgaggtaggggtggggttgttttgaggaggatgattttaacgagggcgtgagtaggggatttaagttggaattattatattgttttattgtatattagagtttttggttagggagtaggttggggattaggtattttattttagcggggtatagtataaagttcgtagggggatggggttattagaaagttgacgatacgagagtggttgggtcggggttgttcggcggttacggagaagttgaagtgttgtagtagggaggtgaagaagaggaagagttttatgcgggttaggggtttttcgaggtatgtacggcggtttgtggggaggggaggggcgttagtgagtttggtttttgggtgatatttttgtaagattttacggaaggggatagggagtcgggttttttataggtatttgttgagaaaggtaggaaggttttcggttttataaagtggttttgggtatttaggaagtgttcggggtggaagcggaagggttttttttagacggttttattttttagtatcgatgataggttggtgatgagtgtcgttttttgggtaggagatgtagggtgagagtggggattggattttaggatgttgggatttttgttattaaatatacgggggatatatattgtttggtatatagttggattttgttaattagttttgcgttcgagaagttttatagtatttttttcgattttatagtagggcgtagttatattttttagaggtatttatattgttttttttttttgtaggcgttgggttttttaatattttggtaggttttgatttgttttttttattagattggggttttggatggataggttagttttgtttatattttggattttttatttaagcggggatagttagtgtggtggtattgaggattaggtggttagggtttttagagtgggtttatttggtagtagttatgttggggttattattaggggttggtgttgagttggggtgaggagggcgttaggtttattttagggatgcggaagttttgtatttcgatgttacgggatgttatatgggttatatttagggggatgatgtttttaaagcgttgtatttcgtgaattacggtagtggtgtagggtatgtgagtttggttatttatttttggtcgtcgtatttgttttattacgtcgtcgattttttgttggatacggattggatagatatgcgtttttataatgggttagtatttaggggatattttttttttttttgtgttggaggaagttaggtttataggagtttggttacgtttgtgttggaagtttcgggtgttttagttaagtttaggggtttttagttgtatttttttttttttagtttttgttttgggttttagttgggtttacgttgtatatttaggtgtaggattatgagtaggaggttttaggttagcgtggtcgaggtggttattatttcggtaaggaataggttatttattattatgcgtaggtttttattattgaagttgtttttagggttttttttggtttgagtagggtcgagaggatatttaggggatagaacggggtagtttttaaatgatttttaattttgtatttgttagtttagatgcggttcgtcgggtgatgtattggtttaattttttgtttagtttttttttattttttttgggacgtttaatttattatttttgttttttatcgtggtagttatttttattttttttttttttgttaggaaggttttagttaggtttcggggtggttgggttgggttttaggttattttgtgtttagttagtagtttatttagttgggttaggaaagttttttggaagcgtaggattttgttagttagcgttgggatgtgcgggaggacggggatagtatttagtatttatattagatagaacggggttttaattttttttgtgttttgcgtttatttggattagttttaggttttagttatttttaggaagatttagggtttgtttgtttttattattgattttattaagtttttttttaagtgttagtttttattttttttttttttgtttagaggagaaatttaaaatcgaaatttttaacgtggacgggggtatagagtttttggttttttttggtgttttttgattcgggtatattttttttacgattatgtttgagatgttttttttttttttaggttttttttatagtggggttttttggaatgtttttttttaaatttatttatgtaaattttgtttttcggaggttttagtttagtttcggtattttttaggagttcgttttgtagagatttttcggtttttcgtttcgtatttcgcgtaggaagttcgattttttttttagttttttttgagttaggtttagtagtttgaggaagcgagggtcgtcgtattcgaagcggcgttcgtaggtgagggaggcgattacgttgtttacggttttgtttaagaggtcgttggggcgaaaggggcgttttgggggtgggagatgcgggtaaggggttgtttttttcgtttttcgtttttttagttttcgttttgtgtttttttgtttattatttatcggtttggtcggcgaaggcggtataaaggtaggcggttttttcggttatttattgttttagcgattttttgtttaggtttaagttgcgtaaggtggatacggagaagcgtttttgttcgcgttacgcgggtttatagcgcgataggattatttttgggggcgggacgggtacgtgggcgttgttatgaaggttttggttttatttttcgttatttattttaattttggcgttttataaggtttttcgtagtttttagttcggtttagttgggtatagggtttattttttgtttatttatattgtttttttgtttggggcggggtttggttttatttcgtttttgtttattttgattatttttttatttaaggaagatttcgttcgtttcgtttatattgagttcgtagtataggcgcggttttcgttatcgttatttcgacgtattagtttcgtttatcgggtttttggcgggtttgggtagtagtttcgtttttttttagtttatagattcgtatttttttcgtgtaggtggttttttggtttattgtttttagtttattcgttggtttttatttttgttttacgtttaggattttacgttttgtcggcgttgtttgggttacggttattgtttattcggggtttacggaaacgcggtttttgttttttatcgtcgtttgttttgggaacgcggttcgaagtttaggatttggtagatgggcgtaggcgggcggtcggtcgtgttttcgtcgcgggttattatcgtttcgcgtacggtcgttagtttattgagtacgattatcggcgtttaggttagttgtaggttgaatacgttttcgaagcggcgtcgtaattgtagagggagggttagggttttttgttaagttaggattattttagattataggttttagttttatttgaattttggacgattttcggggttattaggagtgagtaggtggaaggaggagatttagttttttgattttggggcgggggtgggggttatattttttgtgatggaggaatttagtttggatgcgttatttaggtatgattttgtaagagttattaaaattgtcgagaggttttagttagtattttatttttagatgatggtttatgtcggtgagtagtgaggttcgaggatttatagtgtaaaaggtttgaatcgggttattgtattttttttattttcgatttcgtgatttaaacggtatttaggattaatttattttttatttttaaggtttttttttttggtgttagtagaagggattttgtattttataatatatgttgtttaatgggtttgtatgtttattgttaagtttagttttatttttaggtttttgttttatttttttttggtttttggaaaatttagttttttatgttatgtataaatgtttttttttaggacgttttttaaatttgttttttttttttagtttggtttttgatttagtttgtggtttaatttattatttatgtttgttggtggtggggtatttttaggatttttgtcgttttttaggatttttttttttatttggtcgaagtagtatggtgtgttttggaagtttatatgtagtaaggttgtttagttcgggtagtggtaggggatttggcgggtagcgtgtagtttagcgttggtgtcggtgtattaggtttattaggagtaggaagatggttattattatggttaggggtattagtgtttttagttttatggttgttttattattaattgggtttttttggatatatttggtatttttattttattaggtatagaggattaggtaggatattttcggtatatcgagcgcgtgattttttttttataaagggagttgatgatggttttcgttttttgttgtgagtgaatttgttgtgttgattgtgttgttagtggtagagttaggttagggtaggtatgggttgttttagaggtttttgtcgttgttttttgttttaggtttttatttagggtagggtggtagaaaggtttggtcggagaagttattttttttttttattttaagttttttaagtttatataggtttttgggataattagggttttagtggattcggttatttattttttagttaggtttatatattttaatgtagttataattttttttttagaatatgattttgttttttttttatttttatttgtttattttagagtgatttttagtatttttatttgttattggtatttatttggggttttagagtttttgatgatgagtggtattatgggtttggtttttttattttattttgtatttttgatatgtatagacgttatgtatatatttgatggtgtatagattttttgtttatttttagatatttgtttatttgtttatatttgtagggatacgattatatatgtagaaaattatttatataaagataatatttatatatatatagatttatattgatatttagggtatatatttttttttatatatattagttatatatatatatagattcggtattaagtattttattttttagttatgttcgaggttttttggatgggattttttttgtttagaggttgttttcggtgagttttaaagttgttatatggattttagtttagtttatattttgggttttggtcgggttatgattttttgtttgtaatagggttgtttttagagtttttagttggtagtttgaaggtttttgttttagtttgtgatagtattttttagggttgtttgagggtcgttattttttattgttttttggtttttatgtttttgattagaaatttggtggaaatatta

SEQ ID NO: 295 - DNA, 6001 bp, Artificial Sequence
  chemically treated genomic DNA (Homo sapiens)
taatgtttttattagatttttaattagaaatatggaggttaggaagtagtggagaatgacgatttttaggtagttttggaggatgttgttataggttggggtaagggtttttaggttattaattgggagttttgggaatagttttgttgtaaataggaagttatggttcggttagagtttagaatgtgggttgagttgggatttatgtgatagttttgaggtttatcgggagtagtttttggataggagaggttttatttaggaaatttcgggtatggttgggaagtggggtatttggtgtcgggtttgtatgtgtgtgtgattggtgtgtgtgagagagaatgtgtgttttgagtgttagtgtgagtttgtgtatgtgtgaatattgtttttgtgtgggtgattttttgtatgtgtaatcgtgtttttgtaagtgtgaataagtggataagtgtttgggagtggataagagatttgtgtattattaggtgtgtgtatagcgtttgtgtatgttaagagtgtaaggtgaagtgaagggattaggtttatgatgttatttattattaggagttttaaggttttaggtaagtgttagtgatagataagggtgttgaaggttattttggagtgggtaggtgggggtagggaaagggtaaggttatgttttggaggaggggttgtgattatattagggtgtatgagtttagttgggaggtggatggtcgggtttattgagattttggttattttagaagtttgtgtgggtttggggagtttggagtggggagagggggtgattttttcgattaggtttttttattattttattttgggtaagggtttggagtaggaagtagcggtaaggatttttggagtagtttatatttgttttggtttgattttgttattggtagtatagttaatatagtaggtttatttatagtagagggcgaaggttattattagttttttttataagggaagggttacgcgttcggtgtgtcgagagtgttttgtttggttttttgtgtttggtggggtgggggtgttaggtgtgtttagaggagtttagttggtagtgaggtagttatggggttagaagtattggtgtttttggttatgatagtggttatttttttgtttttggtggatttgatgtatcggtattaacgttgggttgtacgttattcgttaggttttttgttattgttcgggttgggtaattttgttgtatgtggatttttagaatatattatattgtttcgattaggtgagggaggaggttttggagggcggtagaggttttgaggatgttttattattagtaaatatgggtggtgggttaaattataggttggattagaagttaggttgagaaggggaagtaggtttgggggacgttttggggaaggatatttatatatggtatgaaggattggattttttaaaggttaaggaagagtagggtaagggtttggaggtggagttggatttggtagtgggtatgtaagtttattgggtaatatatgttatggagtataaagttttttttgttgatattagaaggaaaggttttgggaatggaagatgagttagttttgagtgtcgtttaaattacgaaatcgaggatgaagggggtgtagtgattcggtttaaattttttgtattgtgggttttcgggttttattgtttatcggtatggattattatttgggaatgggatgttaattggggtttttcggtaattttggtgatttttgtaaggttatatttgggtgacgtatttaaattgagtttttttattatagaaggtgtgatttttattttcgttttaggattaggaggttgggttttttttttttatttgtttatttttggtagtttcgggggtcgtttaaggtttaaataggattaggatttgtagtttggggtgattttggtttgataagaggttttgattttttttttgtagttgcggcgtcgtttcggggacgtgtttagtttgtagttggtttggacgtcggtggtcgtgtttaatgggttggcggtcgtgcgcgaggcgatggtgattcgcggcgaggatacggtcgatcgttcgtttgcgtttatttattaggttttgggtttcgggtcgcgtttttaaggtaagcggcggtgggggatagagatcgcgttttcgtgggtttcgggtggatagtgatcgtagtttaagtagcgtcgatagggcgtggggttttggacgtgaaatagagataaaggttagcgagtgggttgaggatagtgggttaggaaattatttgtacgggggaggtgcgagtttgtgggttgggagggggcggggttattgtttagattcgttagaagttcggtgggcgaggttgatgcgtcgaagtggcggtggcggggatcgcgtttatgttgcgggtttagtgtgggcgggacgggcgggattttttttgagtggaaaggtggttagggtgggtagagacgaggtggggttaaatttcgttttaggtaggggagtaatgtgggtgagtaaagagtgggttttgtgtttagttggatcgggttagggattgcgggagattttgtggagcgttagggttggagtgggtggcggagggtggggttaaggtttttatggtaacgtttacgtgttcgtttcgtttttaggggtgattttgtcgcgttatgggttcgcgtggcgcgagtagaggcgttttttcgtgtttattttgcgtaatttgggtttgggtaagaagtcgttggagtagtgggtgatcgaggaggtcgtttgtttttgtgtcgttttcgtcgattaagtcggtgggtgatgggtagaagggtataaagcgggaattgggaaggcgggggacggagaaggtaattttttattcgtattttttatttttaggacgtttttttcgttttaacggttttttggataaagtcgtgagtaacgtgatcgttttttttatttgcgggcgtcgtttcgagtacgacgattttcgtttttttaggttgttggatttagtttaggagggattgaaggaggagtcgggttttttgcgcgaggtgcggagcgagagatcgaggagtttttgtagggcgagtttttgagaggtgtcggggttggattggggttttcgaagggtaggatttgtatagatgggtttgggaaaggatattttaggagattttattgtaagaagggtttggaggaggaggggatattttagatatggtcgtgggagaggtgtgttcgggttagggggtattaggagaggttaaggattttgtattttcgtttacgttggagatttcgattttaggttttttttttgggtaaggagagagagggtggaggttggtatttggggagggatttggtgaggttagtggtaaggataggtaggttttgggtttttttggagatggttggggtttgagattggtttaggtgaacgtagagtataggagggattgagatttcgttttgtttggtgtaggtgttgaatgttgttttcgttttttcgtatattttagcgttggttggtaaggttttacgtttttaaaaggtttttttgatttagttggatgagttgttaattgagtataggatgatttgggatttagtttagttatttcgagatttgattgaggtttttttggtaaagaaggagaaggtgagagtggttgttacggtggggggtaagggtggtgggttgaacgttttaggaggaatgaggggaggttgggtaaaaggttggattagtgtattattcggcgagtcgtatttgggttgataggtgtagaattggaggttatttgggggttatttcgttttattttttgagtattttttcggttttgtttaggttaaggggagttttgagagtagttttaatgatgagaatttgcgtatagtggtgggtaatttgttttttgtcgggatggtgattatttcgattacgttggtttggggttttttgtttatgattttatatttggatgtgtagcgtgagtttagttggggtttaaggtagggattgagggaggaagggtatagttgggggtttttgggtttagttgggatattcggggtttttagtataggcgtggttaggtttttgtaagtttaattttttttaatataggaggaaggagagtgttttttgggtgttgatttattgtggggacgtatgtttgtttagttcgtgtttaataggagatcgacgacgtgatagggtaggtgcggcgattagagatgggtgattaggtttatatgttttgtattattgtcgtgatttacgaggtgtagcgttttggggatattatttttttgagtgtgatttatatgatatttcgtgatatcgaagtatagggttttcgtatttttaaggtaggtttggcgttttttttattttagtttagtattagtttttggtgatagttttagtatggttattgttaggtgggtttattttaggaattttggttatttagtttttaatgttattatattgattgttttcgtttggatggggggtttagagtataggtagggttggtttgtttatttagagttttagtttagtggggaagataaattaggatttgttagaatgttggaggatttagcgtttgtagggagagggggtagtgtgggtgtttttgagaggtgtgattgcgttttgttgtggggtcggagagggtattgtggagtttttcgggcgtaggattagttgatagagtttagttgtgtgttaggtagtgtgtgtttttcgtgtgtttggtggtaggggttttagtattttagagtttagtttttatttttattttgtattttttgtttagggaacgatatttattattaatttgttatcggtgttgaaggatgaggtcgtttggaagaagttttttcgtttttatttcgaatattttttggatgtttagggttattttgtgaagtcggaggtttttttgttttttttagtaggtgtttgtggggagttcggttttttgttttttttcgtggagttttgtaggggtattatttaggagttaggtttattgacgttttttttttttttataggtcgtcgtgtatgtttcggggagtttttggttcgtatggagtttttttttttttttatttttttgttgtagtattttagttttttcgtggtcgtcggatagtttcggtttagttattttcgtgtcgttagttttttggtgattttatttttttacgagttttgtgttgtgtttcgttagaatggggtatttagtttttagtttgttttttagttagaggttttaatgtataataaagtaatgtggtagttttaatttgggttttttgtttacgttttcgttgggattattttttttagggtaattttatttttgttttatttttgtttattttatcgtttggtcgtatttgagacgggtacgttgaggttgagtagatgttagttatttttgtttataattttatgttttttattgatttaattttgattgtttagattggtgataaggattatattgttttggtatgtggggaaggggttagaatgggttgattagaggtgttagttagttttggatgtggtggagagggtaggatttagtttggaggtttatattttaggtttaatttagtttattttatattagggatagtagttttgttagtattattataatagttatttttttttatatatgatattttaaaatggaagataaattatgttagggagttatatgttagggttattttttagggtttagtcggtaggtgttagaatattttttgggaaggttttaggaaaatttaggatcgagttatcgtttttagtttgttattttgtgtttaaaattggtgggtttttggttttattgattttaagaatgaagtcgtggatttttacggtgagtgttatagtttttaaagatggtgtgtttagagtttgttttttttgatgttaaga

SEQ ID NO: 296 - DNA, 6456 bp, Artificial Sequence
  chemically treated genomic DNA (Homo sapiens)
taagaattttaagttattatttttgtgtatgtaggtagtattagtgttagtaataataagttagtttttttggtaaatttattaaaattaaattttaaatttttgaaaaaattaatatgtttattatgtttttgttagtttagaggtttaattatttgtgggggagggtttataattatgattaattatttatgatttgaaggtatttataaaagtatttgtttttttaagaaattattaaagaattaggtttaagattgtaaaattaattttaggggtaatagtaaattataggtttggggatttaattttgataatttttttttggaaagaaaagaattgttgttaattgtttttattttttgattttgtttgagtaaatattcgtagtttttaaaatttagaatttttagtttggttaagtaagttatggggattaatggttgttttaaggtagaggtagaagagaagaaataggaaggaaataaaaagggaatgaagatttgtagtttatgagggtgatattattaataatttttttaagtattattgaattttatggttcgtgattgagagttttttttgatattttataggttaattatttttaaggatttttttggttttagagtttgtaatgtttgggtttgaatatgatttgttttataaaaaaggttaggtgaattgatttttttttgtgaagttgttttatggtaagagattattaatttgttgaaacgtaaataattttttagatatttgaagtatttttaaatttataaagtgtttttatatacgttattttattttatttttacgattttaataggtaggtgttattattattttaatacgtaaaaataattttagaaaataatgtttttgtttttagtttataagaatatttttttgaaatttatagtatagaatttaagttatgggttagttagaaacgtttagaaatatattaattttaggaggataaattaagagaataggatggattagataaaatttataagtataatggtagaaagtgtgtttttggtataagaatggcgtaagttttgtaaataatagtgttatataggggtgtttttgtagtatttttacgtttggaaggatattatttatttatatatatgataagtatttttaattggatattttataggtaatagataaaataaaataagaattttcgttttaaaattgtagtggtggaatttatttttcgggatgtattaggtgatttttttaggacgatagttgagttatagggggttaaatatattttttttttttttttttaatattataaagagttttaaaaacggattttgttgtttttaataaataaaatatatatgaaaaaaagttatttataggtttttatatataattttattttttaaaatatttatttttttttattagttaggtcgaggtataatgcggttttaattttataattatttattgttttatttatatatttatgattttttgatgttttttagtttgagtttaaattgcgttgggaataaagtatcgtataaattattagtttgggataagaggagataagttaaaattttttaagaagattttgtagatatttggtttttttgagtttgtagagagtttggtattttaaaggttagttttgggtttttttattttgatgattaatgttaaattgtttgattttttataaaaatatttagttgtgtttatttatattattttatttttagcgtatatagtaggtatgtatttgttgaatagaagttttaaatggatgagaaaaaagatatttttgttatatatttttttaagatcgagaaaggtaaaattataatttaatttgtagaagtttttaggtatttttttttaatgtaaagttatgtatttttgtttaaaaaagaaaaggatgatataattaaataatgttaattatataatggggaaattttaggattattaagaaaatattattattttaagttatatatttttatttaatattggttattatataggagagagtaagaattgttgtttttttatttattcgtataatttatttgggaaaagtatgggtagaatatttatgatttaattatattatattttggatttatatttaattttttggagaattagtttaaagagtatgttcgtttagagatataaagtaaaatagatatagggataatagttttggaagaaatttttatgacgttgtttgagattgggtattagtatttaaattttttagattattaggagttatttttattacgtaattttaataaagagaaattgagagtatgattggtaaaaatattatgatgtttttgtattttgttaatttgatttatatttggttttatttataaagtttttattgattattatacggtatttttattttttagttttatttattttgttttttaaaaattttttaacggtatggttacgaaaaatatgcgggggttagcggggtatgttttaggttggtttattttgtttttaaaacgtatttattttttttagatttttttttagggtgggtagggagaaaacgtttttaagttgtatagttgtagggaagtttgtttaggttatgtttttttgatttgtttttcggttcgttgtttggtaaggttatcggttttggttcgcggttttgtcgataaaatttaatttttattttgtaagattaataggtcgcgtaggatttttttagtcgttttttgtttcgtatttttttgggtttgaggattttcggttcggtttttttcgcgcgcgcgaggttttagatggcgagggcgtagttttttggtttatttgattacgttggggtgttcgaaggtttttaggtgttttagtatcgttatttcgcggatggtggagagcggtatgtttttttcgtcggtttgtattcgtacgcgttttaacgttacgaaacggttttcgttttttaagtcgcgggttttgaatatttttttataggcgtttttttcgattttcgttacgtattcgtattgttggttagcgcggtataggtcgtttttttttatgtcgtttggacgtcgttcgtcgcggcgtcgttggggcgggcggggggtgcgtttaattagttggcggtcgtcgttcgtttatttcggggtttttcggagatcggtttagttttatttgtttttcgtcggtttaggcgttcgggcgttggggttttcgtcgttgtagaagttggatggagagattttttcgcggggttggcgtaattttggtgtcgtcgtcgcgaaatttcgtttgtagagtcgtcgtcgtcgtcgtcgtcggaggagcgagtcgattttttttttttttttttcgaagcgaagtttttaatatagatacgattatatagtttttgtttaagcgcgttttagtttagaattattgtatttaaaggaggagacgggaggataagaagaaagtgtaattagatagtttagaagtttttttcggggtttttttagattttttttttttttttttacgaagtttttatcgttatttttcgcgcgtttttgtttttttttaagtcgtttaattttttttggttttttcgagaaaagcgaagttatttttttttttttgtagggttgaagtcgttttcgcgcggagaggttgtaggggtttttcggggatgagcgagcggcgcgggacgtagtggaacgggagggggcgtgtcgagtagtttagagtgtgtcgggagcgcgggggaggggaggcgtcgggtacgttaatgttacggtttaatatttatttttatattattgtgttgcgtcgttatttttttcgttttttgaggttcggacgtgtagggagacggggtttaggggtgtcggagggcgtttaggggtcgcgtataagttggagcggaaggattgtgggtttattcgtgtggggtcgtagaatgtgggtgggggtttttaggattttgtaattcgatgttgggagtgtgcgagaaggggtggttagatatttgtttagaaattgttttttttttttttatttttagtttttttacgaggagatatttaaaaacgattcgtatatataaatggtttttttggggtaaaggagtttcggttggaaacggaatttttttttcggttgggaggatttttttggtggaaattttgggaagattagttatttggtcggggagggttggggtttatcgggggtgggcgagcgagcggttttgggggaggggagatatcgttttttacgggattttaagggtgggagaaaggggtgttcgttataatttcgtttgtcgtttttttaaagaataattttaggaaggggatagtataatcgcgtttcgtttttaagttttaaattgatttcgatttgagtaaaatttaattttttttttaaagggtggggggtggggggttaaattttgcgtttttaggggtgagagagaaggtttttgttttcggggttcggattcgcgaatttttttttatttttaggattttttcgttgtaggtagtagaggtggttgttttatttttttttcggttaaaggttcggtttagtttgtagtcggacgttttcggagttttttgtataataaagcgttagagtagggtattttaattttttttttttatttagtagttatttgggatttagggggttttttttttttagggtcgtcgcggtttcggtaggatttttattacgacggtcgtatgttcggaattttcggggtatttcggaattatttgtttcgtaatcgttggttcgttcgttttttgttaggaattaaataaacggcgcgatttttacgatgagcgggtggagcggatcgcggcgagagtagagtttttggtatttattatatttagaattttttttaaaagtcgaggaaagagtttttagggattgttcgggggtttgagttaggtcgagggttatataggtagtcggggagtcgtcgtcggtcgtttaattcgtttgttttgtatttttttaattttttttcgttcgagtttagtttcgggtttcgtagcgaaggaagcgtcggggacgttttattttcgtagggaattgcgtttgttgttttcgtcgggtttcgtattgttttggttttttttttattcgttttttagacggtcggtttcggcggagagaaacgggagtagtaatgtttttttttttttttttttttatttttttttgttgttgttgttgtttttttacgttggttgaatgtgatttgattttattttaaaaaaagtttgatatagtgttttaatattttcgtattttttcgcgattataaaggttgtagtcgtttttttttgttttttgtttttgttttttgtttttatatttaatgaaattttttatgcgtttttttcgaagtttgttaagtattataagggtcgttattagtatagcgataagaggttatatcggggatcgcgattttcgcgtgtgcgtatacgtagatgcgtttatatgtatacggacgggcgcgttgcggggattagggttgtttattgcggggcgtgtgtttaattttaatattttaaattataaaagtaaatttggaaattatagtaaacgtgcgttttcgcggggttttaagtttgggtattggtcggttgcgtgtatttttttgtgtataatacgttcgtaggaagtttgcgttaatatttatttcgtggaggggaaggtggagtttatatttatattttagcgagttggagagggagttttcgagggggaaatgtaagtatattttttagtatggagtttttagaggtagtgtattttaaattttaaatgtgaattattatgtgagtgttcgagtagagttttagtttcgtttggagaaattgtatgaggcgtgtttcgtgtgggtgtgtgtgcgtacggatacgtggaagtaggatttcggtgtcgcgggtgtttttaggttgggattttttttttttattagataaggagaattttttagttttttaaaattggtttttataattaatttcgttttagttcgtaaggggttaattaaagtcgattttaaggaaatataggttttttttatttttcgttattttttatttattttatttatagttttgtttcggatttcggttaattttttagatttttttcgggattttttatttcgtagtttatttattcgagcgtatagttttttatttgaggggtttagtcgcgtcgggtttttcgagggggttgcgagtgttagtcggtttttcgtacgtgttcgcggtttcgcggagtaggtaattagattttggggaaggagttattagtatttttttcggcgagggggtgggtatagcggcggagggcggagggacggcggagggcgtcgttcgcgtcgttcgttgggggcggacgggggtcgtt

SEQ ID NO: 297 - DNA, 6456 bp, Artificial Sequence
  chemically treated genomic DNA (Homo sapiens)
agcggttttcgttcgtttttagcgagcggcgcgggcggcgtttttcgtcgttttttcgtttttcgtcgttgtgtttattttttcgtcggagagagtgttggtaattttttttttagagtttgattatttgtttcgcgaggtcgcggatacgtgcggagagtcgattgatattcgtagttttttcgggaggttcgacgcgattgggttttttaggtgaggagttgtgcgttcgggtgggtgggttgcggggtggggggtttcgggggagatttgggggattggtcggggttcgaggtagaattgtgggtggggtaagtggagggtggcggggggtgggggggatttgtgtttttttggaatcggttttggttaattttttacgaattgagacgggattggttatgggggttagttttggggagttagaggattttttttatttgatgagagggggagattttagtttagggatattcgcgatatcgagattttgtttttacgtattcgtacgtatatatatttatacggaatacgttttatatagtttttttaaacggaattggaattttattcggatatttatataataatttatatttagggtttaaaatgtattgtttttagggattttatgttggagaatgtgtttgtatttttttttcgaaaattttttttttagttcgttgaggtgtgggtgtgggttttatttttttttttacgagataaatgttaacgtaggttttttgcgggcgtgttatatatagaaaagtgtacgtagtcggttagtgtttaggtttggagtttcgcgaagacgtacgtttgttgtagtttttaagtttatttttataatttaaaatattggagttaaatatacgtttcgtagtgagtagttttggttttcgtagcgcgttcgttcgtgtgtatatgggcgtatttgcgtgtgcgtatacgcgggagtcgcggttttcggtgtggttttttgtcgttgtgttggtggcgatttttgtggtgtttggtaggtttcgggagaggcgtatgaaggattttattgagtgtgaagatagagagtagagatagaaagtagaaggaggcggttgtagtttttgtagtcgcggaggaatgcggaaatgttgaagtattatgttaaattttttttgaaatggggttaagttatatttagttagcgtgggaaagtaataataataataaaaaaaagtggaggagagggggggaaaaggtattgttgttttcgttttttttcgtcgaagtcgatcgtttggggggcgagtggggggagagttagggtagtgcggggttcggcgggggtagtaggcgtagttttttgcgggggtgggacgttttcgacgtttttttcgttgcggagttcggggttagattcgagcgggagggggttggggggatgtaggataggcgggttgggcggtcggcggcggtttttcggttatttgtgtggttttcgatttggtttagattttcgggtagtttttgggggtttttttttcggtttttaaggaaagttttgaatgtagtgagtgttagaagttttgttttcgtcgcggttcgttttattcgtttatcgtgggggtcgcgtcgtttgtttaatttttggtaaaaggcgagcgggttagcggttgcgaggtaggtaatttcgaggtgtttcgggaatttcggatatgcggtcgtcgtggtgaaagttttgtcgaggtcgcggcggttttggaggagggaggttttttaggttttagatagttgttgaatggggagggaaagttagggtattttattttggcgttttgttgtgtagagggtttcgggggcgttcggttgtagattggatcgggtttttagtcggagggggaatggggtagttatttttgttatttatagcggggaggttttgggaatgggaaaaggttcgcgagttcgggtttcgaggatagagatttttttttttatttttggaggcgtaggatttaattttttattttttattttttgaaagggaggttgagttttgtttaggtcgaaattagtttaaaatttaaggacgaggcgcgattatgttattttttttttgaagttattttttaaggagacgataagcgaaattgtggcgaatattttttttttttatttttgggatttcgtgggggacggtgtttttttttttttaggatcgttcgttcgtttattttcgataagttttaatttttttcgattagatggttggtttttttaaggtttttattagggaggtttttttagtcggagagagaatttcgtttttaatcgagatttttttattttaaaaagattatttgtgtatgcgagtcgtttttaaatgttttttcgtagaaaaattgaaagtagaaagaaaggaagtaatttttgagtagatgtttgattattttttttcgtatatttttagtatcgggttatagggttttgggagtttttatttatattttgcggttttatacggatggatttatagttttttcgttttagtttgtgcgcgatttttgaacgtttttcggtatttttggatttcgtttttttgtacgttcgggttttaggaggcggggagggtagcggcgtaatataatgatatagggataaatattaagtcgtgatattgacgtgttcggcgttttttttttttcgcgttttcggtatattttgggttgttcggtacgttttttttcgttttattgcgtttcgcgtcgttcgtttattttcgaggggtttttgtaattttttcgcgcgaagacggttttagttttgtagggaaagaaaagtaatttcgtttttttcggaggaattaggaaggattaagcggtttgggagagggtaggagcgcgcggagggtagcgatggaggtttcgtaaaggaggaggaggggagtttggaggaatttcgaggaaggtttttgggttgtttgattgtattttttttttattttttcgtttttttttttaggtgtaatgattttggattgagacgcgtttgggtagaggttatgtaatcgtgtttgtgttgaggatttcgtttcgaggagggaagaggagggatcggttcgttttttcggcggcggcggcggcggcgattttgtaggcggagtttcgcggcggcggtattagggttacgttagtttcgcggggaggtttttttatttagtttttgtagcggcgaaagttttagcgttcgagcgtttgagtcggcggggagtaagtaaagttagatcgattttcggggagtttcggagtaggcgagcggcggtcgttagttagttgagcgtatttttcgttcgttttagcggcgtcgcggcgggcggcgtttaggcggtatggagaaggacggtttgtgtcgcgttgattagtagtacgaatgcgtggcggagatcggggagggcgtttatgggaaggtgtttaaggttcgcgatttgaagaacggaggtcgtttcgtggcgttgaagcgcgtgcgggtgtagatcggcgaggagggtatgtcgttttttattattcgcgaggtggcggtgttgaggtatttggagattttcgagtattttaacgtggttaggtgagttagggagttgcgttttcgttatttggggtttcgcgcgcgcggggagggtcgagtcgggaatttttaggtttagaaaggtgcggggtagagggcgattggggaggttttgcgcgatttgttggttttatagagtgagagttaagttttgtcgatagagtcgcgagttagagtcggtgattttgttagatagcgagtcgaaagataagttaaaaaaatatgatttgagtaggtttttttgtagttgtgtaatttagaagcgttttttttttgtttattttgaaggagggtttgggggaagtgggtgcgttttagggataggataagttaatttgagatatgtttcgttagttttcgtatatttttcgtggttatgtcgttggggaatttttgaaagatagagtaggtgagattggagaatgaggatgtcgtgtgataattagtgggaattttatgggtggagttaagtgtaaattaggttaataagatgtagaaatattataatatttttgttagttatatttttagtttttttttattaaagttgcgtagtaagaatgatttttggtggtttaaggagtttgagtgttgatgtttaattttaaatagcgttataaaaattttttttaaaattgttatttttgtgtttgttttattttatatttttgggcggatatattttttagattaattttttaaagggttaaatgtgagtttaagatgtggtatggttagattataaatgttttgtttatgttttttttagatggattgtgcgagtgggtggggagatagtagtttttatttttttttgtgtggtaattagtattaaatgaaaatgtgtgatttaggataatggtgtttttttagtgattttggaatttttttattgtgtggttgatattgtttggttgtgttattttttttttttttaaatagagatgtatagttttatattgaaaaggaatgtttagaaatttttgtaaattgggttgtgattttatttttttcgattttgagaaaatgtgtagtagaaatatttttttttttatttatttagggtttttgtttaataaatatatgtttattgtgtgcgttgaggatgaaatgatgtaaataagtatagttaaatatttttgtaaaaagttaaataatttaatattagttattaaagtggagagatttaagattgatttttgaaatattaaattttttatagatttagagagattaaatatttatagaatttttttgggaggttttaatttgtttttttttattttaggttggtgatttgtgcggtgttttgtttttaacgtagtttagatttaagttagaaggtattaaagaattataaatatataaataaggtagtaaatggttataaagttaagatcgtattatatttcggtttagttagtgaaggagaatgagtgttttagaagatgagattatatataaaaatttatagatgatttttttttatgtgtattttatttgttaaaaataataaaattcgtttttggggttttttgtgatattggagggaaaaggggagggtatatttagttttttgtaatttagttgtcgttttaggggaattatttaatatatttcgaaggatgaattttattattataattttaagacggaagtttttgttttattttgtttgttatttatggagtatttagttaagggtgtttattatgtatatgaatgaatagtgtttttttaaacgtagaggtattatagaggtatttttgtataatattattgtttataaagtttacgttatttttatattagaggtatattttttgttattgtgtttgtagattttgtttgatttattttatttttttgatttatttttttgagattgatgtgtttttagacgtttttaattgatttatgatttggattttgtattgtgaattttaggaggatatttttatgaattgaagataaaggtattgttttttaaaattatttttacgtgttaaggtgatgatggtatttatttgttaaagtcgtgagaataaaatgagatggcgtatgtgaaagtattttgtaaatttgaaagtattttagatatttaaaggattgtttgcgttttagtagattgatggttttttgttatggagtagttttatagggaggggttaatttatttgattttttttgtagaataaattatatttaaatttagatattataggttttggaattaagaagatttttgaggataattagtttgtaagatgttagaaaagatttttagttacgagttatgaaatttagtgatatttgaggaaattattgatgatgttatttttatgagttatagatttttattttttttttgttttttttttgtttttttttttttgtttttgttttgaaataattattggtttttatgatttgtttggttagattaagaattttggattttagaggttgcgaatatttgtttagatagggttaggaaataaggatagttgatagtaatttttttttttttaagggagagttgttaaagttgggtttttaaatttgtgatttattattgtttttgggattagttttatagttttaagtttggttttttaatggttttttaaaagggtagatgtttttataagtatttttaagttataagtaattgattataattataggtttttttttatagatagttaagtttttaagttaataggagtataataaatatattagtttttttaaaagtttaagatttaattttgatggatttgttagaaaagttgatttgttattgttggtattggtattgtttgtatgtatagggataatgatttgaaatttttg

SEQ ID NO: 298 - DNA, 4499 bp, Artificial Sequence
  chemically treated genomic DNA (Homo sapiens)
tttagaggttattattcgaattttggttaattgtgaggaaaggttggaagaggagtttggagatggattgtggtaattttggaagatttatgttttggaattcgagagaaagagaggaggttatattatttaggagagaggggttgttgaggtggggtgagttggaatttgtttttataagttatttttgttttttggtttttagggatttgggggtttttggtttttttttttattttggtttaggattaagtttttttttaatttttttttttgtacgtggatttttagatttagtttggtgttttagttagagtttaggttatagtggggagcgcgagtgaggagtatgttttttgatgggttttttagcgagggtcgaaaggtagatgttgaaaaggtgattcgtttagatttacgggattagtcggggtagttttgggatttttagagtttttaaagacgatggtttaaaaattaggagtagcgtgagcggttgtcgagttttattttattcgtaagttttcgttaagtattgggtaggaaatatgatagttaagaggattggagcgttgatttttttttttgggagtgatatttgggatagtttttaaggttgaagggtttaggtttttttcgtcgtttttatttggggacgttttttttggtttttcgtcgtcgcgtatacgtattagttgggtagtaggagattagttaatgagattgtaaacgttgtttgtttttatttatttatttttgagattgagtttcgttttgtcgtttaggttggagtgtagtggcgcgatttcgatttattgtaagtttcgtttttagggtatacgttatttttttgttttagtttttcgagtagttgggattataggcgttcgttattacgttcggttaatttttttttatttttagtagagacggggttttatcgtgttagcgaggatggtttcgattttttgatttcgttattcgtttttttcggttttttaaagtgttgagattataggcgtgagttatcgcgttcggttcgttgtttgtttttagttattgattgttaaaagattaagttgttggtaagtcgatattaataattttttcggaaaaattttttaattaagttaataatagaaaaatattggttgtaattgtagatattagttatttcgaagatgtgtgagagggaggtatagtgggtttcgggtaggttgtaggggtgtgtgcgcgcgaacgtgttgggttcgggagattgagagtgtgtgtgtaagatttcgggagggagtttttttttcggggtgaggagtgcggattgtagtttttttaggttagttttcgtttaatattttttataatttttaatttttaagtttcgtatattcgtttcgttttaggttggatagttatttttagggatttttttttttgttttatttagaaggaggtagttgcgagtcgggcgtggtggcgggcgtttgtaattttagttattagggaggttgaggtaggagaattgtttgaatttgggaggcggaggttgtagtgatttaaaatcgcgttaatgtattttattttgggcgatagatcgagatttcgttttaaaaataaataaataaataaacgaagtcgttgcgagcgtttttttttttttttttttttgattagttgagttgtatcgattaaggattattcggttcgggcggcgggatagggagggtttgggcgagtttttttcggagttttggagttcgtaggagatttgcgggggcgggttgcgtttttaagagagcgagcgtttttaagagagcgagttttttgttatgggcggtgtttataaaatgcgtttttgtgggcgatagaggggtgcggtggggtttaggaggttcgtgggcgatttcgagtatcgggtcggtttcgagtgaggggttagttttggggttgggaggaaggcgagaggtagcgttattgtttttgatttttcgggcgattttacgaaggaaggtagagggttgagttttagcgcggattagttaaattcgacgggtttttgtcggttattcgtttttaattttggttgggttgggaggggttttttcgtaagttttttcgttcggcggaggttttttttttttaattttcgcgacgggcgtatgttttaagttgttttcgttcgtcgggttcgtttgtcgtttttagggtttggtggttcgcggtggttcgcgtttatcgtgtcggttttatcgatttcgattaacgtaggttcgagatgcggcggttttcgtcgagtgggcgcggcgttcggggtttttcgggagtaggtgcgaaggacgtgtttggagtttgtcgtttggatttttggtttttgggtgcgtagtaatttttcgcggtaggattgtaatcgcggaggtttgtagttgtgattaaattcgcgtttttttcgtcggtttcgcggttcgtagtttattcgggttaatggtgttaattttggattttttttaatgtcgggttttgtggtattcgggaaagtttttacgtaggaaggtttagggttttgcgggtgtatatatgggaaggtataaaagttatagatattgtttgtttaaattgaagttcggtggaaagttatgtttttttattttttaaaaaatttaattttgttgaagtatagtttatatgtaataaaatgtatttattttaagtggatatttagatatatattttgatatagttatattttattattatgattaagatatagaatatttttatgtttttaaaaattattttgtgttgttattttagattattttgtgtttttttatttattttattttatatatttgagttttaggtaatcgtcggattgtttttttttattatagattatgtttttgtattttttggagttttatattaatggaattatatattatgagttttgtgtttgatttttatttagtttaatgttgttgagatttttttttattgttggaaagattagtagtttatttttttgtgtgtgagatggagtttcgttttgtcgtttaggttggagtgtagtggcgcgattttagtttattgtaattttcgttttttgggtttaagcgattttcgtgttttagtttttcgagtagttgagattataggtattcgttattatattcggttaatttttgtatttttttaatagagacggggttttattatgttggttaggttggtttcgaatttttgattttaggtgatttatttatttcggtttttttaagtgttgggattataggtgtgagttatcgcgtttagtttttttattgttgatattgtattgtttggttgtatcgtaatttgtttaattttttttttgtttatagatatttggatttttttttagtttgggttattttgaattaagttgttaggaatatttgtttaattttgtgtgattttatgattttattttttttgggtgtatatatagaaatggaattggtgggttatattagaaaatatatttttaatgttgtaagaaattgtaaaattattttttaaagtggttgaagtattttatatttttattaatagtatatgaaagttttagttatttttatatagttattaatttttagtattgttagtttttttaattttagttatgttagtgggtgtttagtggtattttattgtatttttaaattttattttttaaataattacgttgagtattttatgacgtgttcgttttaaaaatgtgtatattttatttagtgtaatgtttgtttaaatattttatttatttttattaggttatttgttttatattattgagttgtaaaagttttttatatatttaggatataatttttttatttatgttttgtatatatttttttatagtttgtggtttgttttattattttttttttttttttttttttttttttttttttttttttttgagacggagttttatttttgttgtttaggttggagtgtaatggtgtgattttagtttattataattttcgttttttaggtttaagcgatttttttgttttagttttttaagtagttgggattatggttatatattattatgttcggttgattttgtatttttagtagagatggggtttttttatgttggttaggttggttttgaatatttgattttaggtgattcgttcgttttggtttattaaagtgttgggattataggtatgaagtattatatttaggtttttttgttttgttttgttttgtttttgtttttgtttttttaagatagagttttgttttgttatttaggttggagggtagtggtatgattttaggttattgtaatttttattttttgggtttaagcgatttttttgttttggtttttttagtagttgagattataggcgtgcgttattatgtttggttaatttttgtgttttttagtagaaatggggttttgttatgttggttaggttggtttcgaatttttgatt

SEQ ID NO: 299 - DNA, 4499 bp, Artificial Sequence
  chemically treated genomic DNA (Homo sapiens)
ggttagaagttcgagattagtttggttaatatgataaaattttatttttattaaaaaatataaaaattagttaggtatggtggcgtacgtttataattttagttattggggaggttaaggtaggagaatcgtttgaatttaggaggtggaggttgtagtgatttgagattatgttattgttttttagtttgggtgatagagtaagattttattttgaaaaaataaaaataaaaataaaataaaataaaataaaaaagtttgggtgtggtgttttatgtttgtaattttagtattttggtaggttaaggcgggcggattatttgaggttaagtgtttaagattagtttgattaatatggagaaattttatttttattaaaaatataaaattagtcgggtatggtggtgtgtgattataattttagttatttgggaggttgaggtaggagaatcgtttgaatttgggaggcggaggttgtggtgagttgagattatattattgtattttagtttgggtaataagagtgaaatttcgttttaaaaaaaaaaaaaaaaaaaaaaaaagagagagaaaaagaaaatgatgaggtaagttatagattgtgagaaaatatatgtaaaatataaataagggagttatattttaaatatatagaaaatttttatagtttagtaatataaaataaataatttgataaaaatgagtgaaatatttgaatagatattgtattaaataagatatatatatttttaaaacgaatacgttataagatgtttaacgtagttatttgagaaatgaaatttaaaaatatagtaaggtattattgggtatttattagtataattaaaattaaaaagattggtaatattaaaaattggtggttatgtggagatgattggagtttttatatattattggtgggagtgtaaaatgttttagttattttagaaaatagttttgtagttttttataatattaaaaatatattttttgatatgatttattaattttatttttatatatgtatttaagagaaatgaaattataaagttatatagaattgaataaatatttttaatagtttaatttaaaatagtttaaattgggaaaaagtttaaatgtttatggataagagaaaggttaaataaattgcggtataattagataatgtaatattagtaataaaaaagttgggcgcggtggtttatatttgtaattttagtatttagggaggtcgaggtgggtggattatttgaggttagaagttcgagattagtttggttaatatggtgaaatttcgtttttattaaagaaatataaaaattagtcgggtgtgatggcggatgtttgtaattttagttattcgggaggttgaggtacgagaatcgtttgaatttaggaggcggaggttgtagtgagttgagatcgcgttattgtattttagtttgggcgatagagcgagattttattttatatataaaaaggtaaattattgatttttttaataatagggaggggttttaataatattaagttaagtgaaagttagatatagagtttatagtgtatgattttattgatatgaaattttagaaaatataaaaatataatttatagtagaagaaagtagttcggcggttgtttagaatttaggtgtgtgggatggggtgagtagagggatatagggtagtttgggatgatagtataaggtaatttttgaggatatggaaatgttttgtattttgattatggtagtggagtgtgattgtgttaaaatatgtatttaaatatttatttaaagtgggtgtattttattgtatgtaaattgtattttaataaagttgaattttttaaaaagtaagaaggtatagttttttatcgagttttaatttgaataaataatatttgtagtttttgtgtttttttatgtgtatattcgtaggattttgggtttttttgcgtggagattttttcgggtgttatagggttcggtattgagaggaatttaaagttgatattattagttcgggtggattgcgggtcgcgaagtcggcggaggaggcgcgagtttagttatagttgtaggttttcgcggttgtaattttgtcgcgaggggttgttgcgtatttagaggttagaggtttagacgatagattttagatacgtttttcgtatttgttttcggaggatttcgaacgtcgcgtttattcggcggaagtcgtcgtatttcgaatttgcgttaatcggggtcggtgggatcgatacgatggacgcgggttatcgcgggttattaggttttgggagcgatagacgagttcggcgggcgagagtagtttaaggtatgcgttcgtcgcgggggttgggaaggagaagttttcgtcgggcgagaagatttgcgagaagattttttttagtttaattagggttagggacgggtgatcggtaagggttcgtcgagtttggttgattcgcgttggggtttagttttttgttttttttcgtggagtcgttcggggagttaggagtagtggcgttgtttttcgttttttttttagttttagggttggttttttattcgggatcgattcggtgttcggaatcgtttacgagttttttaggttttatcgtatttttttgtcgtttatagaggcgtattttgtggatatcgtttatgatagggagttcgtttttttggagacgttcgtttttttggagacgtagttcgttttcgtaaattttttgcggattttaaggtttcgggagggattcgtttaggttttttttatttcgtcgttcgggtcggatggtttttgatcgatgtagtttagttaattagagggaaggagaggaggggacgttcgtagcgatttcgtttgtttgtttgtttgtttttgagacggagtttcggtttgtcgtttagggtggagtgtattggcgcgattttgaattattgtaattttcgttttttaggtttaagtagtttttttgttttagtttttttagtagttggggttataggcgttcgttattacgttcggttcgtagttgtttttttttgagtaaagtaggaggaagagtttttgggagtaattgtttagtttggggcggggcgagtgtgcggggtttgggggttaggggttgtggggagtgttgggcggaagttggtttgggagagttgtagttcgtattttttatttcggagaaaaagttttttttcgaaattttgtatatatatttttagtttttcggatttaatacgttcgcgcgtatatatttttgtagtttattcgggatttattgtattttttttttatatattttcgaaatgattagtatttataattgtaattaatgtttttttattattaatttagttaaaagattttttcggagggattattgatgtcggtttattagtagtttaattttttaataattagtaattaaaagtaaataacgggtcggacgcggtggtttacgtttgtaattttagtattttgggaggtcgaggagggcggataacgaggttaggagatcgagattattttcgttaatacggtgaaatttcgtttttattaaaaatagaaaaaaattagtcgggcgtggtggcgggcgtttgtagttttagttattcgggaggttgaggtaggagaatggcgtgtattttggaggcggagtttgtagtgagtcgagatcgcgttattgtattttagtttgggcgatagagcgagatttagttttaaaaataaataaataaaagtaaataacgtttgtagttttattgattggttttttgttgtttagttagtgcgtgtgcgcggcggcggagagttagaagagacgtttttaggtgggagcgacggagagaatttgggttttttagttttgaaggttgttttaggtattatttttaggagaaaaagttaacgttttagtttttttggttattatgttttttgtttagtatttggcgagagtttacgagtggaatggaattcggtagtcgtttacgttgtttttggtttttggattatcgtttttgggaattttgggagttttagagttgtttcgattggtttcgtgagtttaagcgagttatttttttagtatttgtttttcgattttcgttgaaaaatttattagaggatatgttttttattcgcgttttttattatggtttaggttttggttggagtattaggttgggtttgggaatttacgtgtagaaaaagaagttaaagagaaatttgattttgggttagagtgaaaggaaagattaaaggtttttaaatttttggaagttaaagggtaggaataatttatgagagtagattttagtttattttattttagtagttttttttttttaggtggtatggttttttttttttttttcgaattttaggatatgggttttttagaattgttatagtttatttttaaattttttttttagtttttttttatagttgattaagattcgaatggtggtttttaaa

SEQ ID NO: 300 - DNA, 4500 bp, Artificial Sequence
  chemically treated genomic DNA (Homo sapiens)
ttatgtgaggatatagggtaacgatagttatttatagttaaggaagagaggtttttaatagaattaattttgtttatatttggattttaaatttttagtttttagaattgcgcgaggagaaacgtttgttgtttatgttatttggtttgtggtagattaatacggttatttattagtcggttggttttgggtaggttttttatgttttttgtgttttagttttttttattgtagaatgggatagtaatgtgtttattttttgggttgtggtgagtcggttaagatgtgaagagtttggagtaggttgagtaggggtattgtaaatttgtttttgtttttatatttttttacgatttagaggtcggggatattgggtattttgtttgtagtttttacgttagtttatttttaaatattttaattagagtttttataaatatagttaaacggagtagaggtaggtagggtttgttttcgatagtttttgttaaggacgttcgattaaggttggtaaggaaggtggttagggtttagagtttattgttttttgggaggagaaattaaaatataaatgaaaaagggtttcggggttgagtagggtatggaggtggttaggataggagtttagttgtaggtatagttttaatttatgtgatttttagggatttggaaagggatttggtttagtttacgtggtagttatttttttaattttttaattgcggttttaggatggttgttgggatttttagagatggatttttacggtttttaggggtgtaaaggaaggatagtgtggagtgtgttgtaagttttaatcgatattgtttgagtatttgttgtatattaagcgtttttatatagtgaaggcgaggttgtaggttatgtttagtttatagatagagatattaaggttatttaggtattaaggtgatgtagttatcgaggttatacgagaagtaagagggtatttttgtggtaggtgggtagtgggagttagtgtgagttggggagcggagatttaaagagttgtgttgggtggttagggaggttttgatttaatgtttagtattaggtgagttgatttgggggtgtttatgtgtttatttatgggagattaggaggtagaggtaggttgggatgagagttttgggggtagagttggttcgggcggtttttttttatagattttatagtcggagatggagatggtttaggggtatgtttgtttgcggttttggttttttaagagttttgagattaatgttttcggtttagtttaagtcgtataggaaagttattttgtggattaagtttgggtatatagagagggttggattttatacgtatttgtggtaggtttttggagatttttggaatatttttgtattttttttttatttttaagtaatatttttttgggaaaatgtttatttggttttagttgaatttaggaaattgattgttatttatttatatatttagagtttaattggggtggtagggatatatgtataggatcgtgtttacgtttgggttgtatgttcgtagttgggggatatatatatagagtgacgtgtatttattatttatatatatatattggttatatatatgtttatattaaattatttgtttataattatttatatatatattatttttatatttatattttatagttgttgaggagggtgaggataggtcgttatttttattttttttataggatgagttgtaaaacggtttagaggttttagcgagggtgtatgcgtgttcgtcgagtgttttagcgtttcgggatagttttttttagtatcgttgatatagtttttattgttttttgaagtgtagataaaacggagggtagttttgtttagggtttttttggttttaggaagggttaataggtagtaagggttgttttttttaggaacgtttcgttcgagtagtaagtgattgtttagtttcggtttcgggggatttttttgagatttgtgagtagatgaagttggggattagtagatatagttttaggtcgggaggaaaaatttatgtgtgatttatgatgtttttttagacgtggggcgatgtaggtggtttggagttagggttgacgtttaggattttaatatttttttgtatttaaggggtggatttgggggttatgtaggtattaaggtaaggtacgagcgtgtgagcgtgtagtagatagtatggtagtgtggttttattttaagttgtagggtagagtacgagagatttaacgtggtttttggatggggttttaattattttgtacggttaaggtttaagttttaagagttgggtagtttttcgtatgtggggcggttataagtttgtagttgttttttttgttgtatatttatttcgagtttattttggagtaggtttgggttttcggggtatttttatattttatttgtttatttttaaataatttttaggttagaaaattttttgagaagggatagtaggatttgggatttttttatttatttatttatttatttatttattttttttttaataaatattttggcgagcgtagtggtttatgtttgtaattttagtatttagggaggttaaggtgagtggattatttgaggttaggagttcgagattagtttggttaatatggtgaaattttgtttttattagaaatataaagattagttaggtatggtgacgtatatttgtaattttaattatttaggaggttgaggtaggagaattatttgaatttaggaggtagaggttgtaatgagttgagattatattattgtattttagtttcggtaataagagcgagattttattttaaaaaaaaaaaaaaaaataaaaaagtttcgtgggttgggtatagtgttaattgttagtaatatttaggtaaggaagatgtttatttggtttttgtttattaggaatttggaggttagaaatatagtttttttgtagataatttgtagtaggatagaaaataaagtttggttatggtggggttatttagtttgaggtatttaggggaggttttttggaggaggtggtttagttaaagttttgaaggatgtataagagtgagtgagttaaggaaggggtcggtacgagttaagtcgtagagtttaggggataggttaggttggagaagggatgttgagaggttttatgaagttcgttttttgttgttaatgaattttttatggaggtttggaagtatcgtatggttttagtatatatttcgattttattattttcgttttcgtatattagttggggatgttgttttaggaagtgattttattttttaaatataatgcgtttttttgtaatttaattttttcgggggtgtgtggaggttcggaagttggtttgtttgtttttgtagttggtggttgaagtgtttttgttttttcggttatggttttttcgttttttttttgtgtgtgtgtttttttgagatagggttttattttgttatttaggttggagtgtagtggcgcgattttgttttattgtaattttcgtttttcgggtttaagcgatttttttgttttagttttttgagtagatgggattataggcgtatattattatattcggttaatttttgtatttttttagagacggggttttattatgttggttaggttggttttaaatttttgattttttgattcgtttgttttagttttttaaaatgttgggattataggtatgagttatcgtgtttggttatatttatattttgtggggattagggttttttgttataattaatttataatagtcgaaggaggttatgaggttttagcgggatttttgggggatagggatgggaggaaatttaggattagatagattataaaatcgtttatagatttttgtttttagttgtttttgttgagaattgggagttagaaaaaggaggttaaattttagggtaatgtttatgttttttgtaatttttggttttattaaattagtagtataattttagttttattttgtagagttagatataatggggtattagaagggaattgaatttttttttaattataatggtttatagatattgtttaatttgtaatttgggagttaatgtggttttttttttttgtagttatggggtcgtttgtatatatatgtttttatttattcggacggagtatggggtttattttgtaaggtgagacgtcggataaggtcgtttttagttcggtgagtggagtgtcgcgtttagttttgttttttttttgtttttagttaggtttattatatagaggacgttagtgtggttgttatatgttatatggagtatatatgtatggagttattttaataggtaggtaggagtataattttttttttaattatatatttagtatttttgagaaaatgagattttagtaatttaattggattgagaagcggggttataataaaatggaatttgtaataatcgcgtagttaaattag

SEQ ID NO: 301 - DNA, 4500 bp, Artificial Sequence
  chemically treated genomic DNA (Homo sapiens)
ttaatttaattgcgcgattgttataaattttattttattatagtttcgttttttagtttaattgaattattaaaattttatttttttagaagtgttgaatatgtaattagaggaaaaattatgtttttgtttgtttattaggatggttttatgtatgtgtgttttatgtgatatgtgatagttatattgacgttttttgtgtggtgggtttggttggaggtaggagagaggtagggttgggcgcggtattttatttatcgggttgggggcggttttgttcgacgttttattttgtagggtgggttttatgtttcgttcgggtgaatgagaatatgtgtgtgtaggcggttttatgattgtaagaggagaaaattatattaatttttagattataaattaaataatgtttgtgggttattgtaattaaagggaaatttaatttttttttaatgttttattatgtttggttttgtaaggtaaagttgggattgtgttgttagtttaatgggattagaggttataaggagtatgaatattattttgagatttggttttttttttttggtttttaatttttagtaggggtagttgggggtagaagtttgtgagcggttttgtaatttgtttagttttgaatttttttttatttttgttttttaaaagtttcgttggggttttatagtttttttcgattgttgtgggttgattgtggtaggaggttttggtttttatagagtgtgggtgtggttaggtacggtggtttatatttgtaattttagtattttgggaggttgaggtaggcggattaagaggttaggagtttgagattagtttggttaatatggtgaaatttcgtttttaggaaaatataaaaattagtcgggtgtgatggtatgcgtttgtagttttatttatttaggaggttgaggtaggagaatcgtttgaattcgggaggcggaggttgtagtgaaataagatcgcgttattgtattttagtttgggtgatagagtgagattttgttttaaaaaaatatatatataaaaaaaaaacggaagagttataatcggaagagtaagggtattttaattattagttgtaagagtaggtaggttagttttcgggtttttatatattttcgagggggttaagttgtaggaagacgtattgtatttaaaaggtgaggttattttttggagtagtatttttagttggtatgcggagacggaagtgatgggatcggggtgtgtgttggagttatgcggtgtttttaggtttttatgaagggtttattggtagtagaggacgggttttatggggttttttagtattttttttttaatttgatttgttttttgggttttgcgatttgattcgtgtcggttttttttttggtttatttatttttgtgtattttttaaggttttagttgggttattttttttagggagttttttttgagtgttttaggttggatgattttattataattaggttttgttttttgttttgttatagattatttgtagaggggttatgtttttaatttttaaatttttggtgggtaaaaattagatagatattttttttgtttgggtgttgttagtagttagtattgtgtttagtttacgagatttttttgtttttttttttttttttgagatggagtttcgtttttgttgtcgagattggagtataatggtgtgattttagtttattgtaatttttgttttttgggtttaagtgatttttttgttttagttttttaagtagttgggattataggtgtgcgttattatgtttggttaatttttgtatttttagtagagataaggttttattatgttgattaggttggtttcgaatttttgattttaaatgatttatttattttggtttttttaagtgttggaattataggtatgagttattacgttcgttaagatgtttattaagaaaaaaatgaatgaatgaatgaatgaatgaatgggggaattttaagttttgttgtttttttttagagagttttttggtttaagagttgtttgagagtgggtaggtgggatatgggggtgtttcgggaatttaggtttgttttagggtgagttcgggatggatatatagtaggagggatagttgtaggtttgtgatcgttttatatacgggggattgtttagtttttagaatttaggttttggtcgtataggataattgagattttatttagagattacgttgggtttttcgtgttttgttttgtagtttgaggtgggattatattgttatgttgtttgttgtacgtttatacgttcgtgttttgttttagtgtttgtatggtttttaggtttattttttgggtgtagagaaatgttggggttttaggcgttagttttggttttaggttatttgtatcgttttacgtttgggagggtattatgaattatatatggattttttttttcggtttggagttatgtttgttaatttttagttttatttatttatagattttaggagaatttttcggggtcggagttaggtagttatttattattcgagcggagcgtttttggggaaggtagtttttgttgtttgttggttttttttggggttagggaggttttgagtagagttgtttttcgttttgtttgtattttagagggtagtgggggttgtattaacggtgttggggagaattgtttcgggacgttggaatattcggcggatacgtatgtattttcgttgaagtttttgagtcgttttgtagtttattttatgagggaggtgggagtagcgatttgtttttattttttttagtagttgtagggtgtgagtgtggaggtagtgtgtgtgtgagtggttgtgagtaaatgatttagtgtggatatgtgtgtgattaatgtgtgtgtgtaagtgatgggtgtacgttattttgtgtgtgtgttttttagttgcgggtatgtagtttaggcgtgggtacggttttgtgtatgtgtttttattattttagttgaattttgagtgtgtgagtgggtggtaattaattttttggatttagttgagattaggtgagtatttttttaaaggaatattgtttgagaatgaagggagaatgtaggggtgttttaggagtttttaggagtttgttatagatgcgtgtggagtttagttttttttgtgtgtttagatttggtttataggatggtttttttgtgcggtttgggttaagtcgggggtattggttttagagtttttggagagttagggtcgtaggtaggtatgtttttgagttatttttattttcggttatagaatttgtgaggaggaatcgttcgggttagttttatttttaggatttttattttaatttgtttttgttttttggttttttataagtggatatatgggtatttttaggttagtttatttggtgttgggtattgagttagagtttttttggttatttagtatagttttttgggttttcgttttttaatttatattaatttttattatttatttgttatagagatgtttttttgtttttcgtgtggtttcggtagttgtattattttggtgtttgggtggttttggtgtttttgtttgtgagttggatatggtttgtagtttcgtttttattgtatgaaagcgtttagtatatagtaggtgtttaagtagtgtcggttggggtttatagtatattttatattgttttttttttgtatttttggaagtcgtgagagtttatttttgggagttttagtagttattttggggtcgtagttaggaagttagagaagtgattgttacgtgggttgagttaggtttttttttaggtttttaaaaattatataaattggggttgtatttgtagttgggtttttgttttggttatttttatgttttgtttagtttcggagtttttttttatttatgttttaatttttttttttagaaaatagtgagttttgagttttagttattttttttgttagttttggtcgggcgtttttagtaagggttgtcgggagtagattttgtttgtttttgtttcgtttggttgtgtttgtaggggttttggttggggtgtttaggagtaagttggcgtgagagttgtaagtaaggtgtttagtgttttcggtttttgagtcgtggggaagtgtaagaataggagtaggtttgtagtgtttttgtttagtttgttttaggttttttatattttaatcggtttattatagtttaagaggtgggtatattgttattttattttatagtagaggaaattgaggtatagagggtataggaagtttgtttagggttagtcgattagtaagtagtcgtattggtttgttatagattaggtggtataaataataggcgttttttttcgcgtagttttgaaggttgggagtttgaggtttaggtgtgggtagggttggttttgttggaggttttttttttttggttgtggatggttgtcgttgttttgtgtttttatatgg

SEQ ID NO: 302 - DNA, 6499 bp, Artificial Sequence
  chemically treated genomic DNA (Homo sapiens)
tattgtatatttttatttataattggtagttaattattgaatatatatagatataaatgtattttaatatattattatttttatttagattttgtgtaatatttaattatttaattatattaataaataaaagtttttagaaattgatgtatttagtataattaaggggtaatttgtttatgattataggagttattttatttatattaatttgatgtgaggagataattaaatttttttttttttataagaaaaatttaatttcgggaggtttaggtaggagaattttttgaatttaggaggtagaagttgtagtgagtcgagattgtattattgtattttagtttgggtaataagagtgaaattttgttttaaaaaaataaataaataaaataaaataaaaagtaaaatttaatttttatattttttttttaaaaatattatattattgaaatagaatagaattttggattttaatgtttttatgttttttgataatgtaaagattatattaagaataatattgattttttgtgtatatgtgtgaaattatgtcgagttgatgtatttagaaaagaaattgtagcgatattgggtatagaatttttaattttaattttttttttgttgtggaatagaaatttagttttattttttttgtttataatatataagagtagataattagatatgaggtgattaaatatataaattgattttatagttattatggaaagattataatatgtttggacgaggtgggggaaagagtttttttttgaattgagatttgaataggttttagatagattaaaaatttatggtttgttttttttaattttttattattgattatttgggagaattaaaatggtttggattataaagtgattataattagtagggtaggtatattaaataaaaatggggtgagtgtgtttggatgggaaaaattggggtgtagagaaatattttttgttttggaggtttcgtttatagcgagtttgaggatgtagatgatatggaatatgagttttattaggatatatatttttttgtatagttttttttgattagtgttgtttattgttttaggtattatttttagttattttgtgttaggtatttaggatagttttgtttaaagtatgattgttttttggttagtgaagaaatagtaaagaaatgagagtttgtttttgaagtttttgtagtaatttaatatttttgtaatgtcgtggtatatgttttatattttttaaaagtatttatttgtagattagaaataaaagagttttttagtatagatagtttgagagatgttattgtagagtgttttgggaggatgggatttttttagatattgacggttttttggagtggtgttggagtttgttgagatagggacgcggggattgttgtggaatagtatgttgtgaaaataggtatagatgggttgttgttacgtatttagtatttggtaggtttaggtattttgtttcggggagatagagtaatagttgttatttttaaaaatgtgatataaatatgattttcgttttttattgtatgtgtatgtatgtgtgtatgcgtatgtgtggttggtgtgtgggtaaataatattggtgagggagttagtagtgtagagacgtagagatgaatttaatgaatttatatttggaggtttttgaaaggagttttgtgtatgtataattaggaagtagaagtgtagtcgtaggttagttttattttttggtggaaatagtaaattatagttttagtattttttatttgtagtaaaagaaatgtatgttgtatttgggaggggtaggagaattttttagaatttggtgggtttattagttagggttgtgtagagaaatagaattaatgagataaatatgttagatagatgatagatagatagatagatagatagatagatagatagatagatagagatgatagatgatatagatagatgatagatgatagataatagatgatatatagatagatatagtaaatagatttatagatatgatagagagagaatgagagagatttatattaaagaattggtttatatgattgtgggggttgtaaattttatatttgtagaatttgttggtaggatggaaatttaggtaagagtggatattgtagttttgagtcgaaagtttatagggtagtaagttggaaatttaggtaaggtttttaggttgtagttttaagaagaattttatattttttaggaaattttagtttgtgtttttagggtttttaattgattgaatgaagtataaatattatggaaggaaattcggtttatttaaagtttgttggattaagtattaattttaattaaaaaacgtttttatagtaatatttagattattgtttagttaagtatttgggtattatagtttagataagttgacgtataaaatttattattataagggaggaatttatatatatattttattgtagtaaaatttttatagtttaacgttttgtattttttttagaaggaaacgttttagtgtagagttgaatatcgtattttttcgtagtttatataaattttatataattttgatttgttgagttttttttgaaaattggataatttaagtgtttatgaaaggttttaattgtttaagaaaatagattgtttgtgtgaattataaagaaaaagggattttagaaggaatattggtatttcgggaagtaggttggggtaaggtttgtataagtgaattagaagttttaggtacgaagttagtatttttgttatggtttatgttagttgagtttttatttttgtttcgtgtttggtttttagattttgtgagttcgtttcgggatagggttacggttaatttagtagagattttggtaaagtatttcgggaatgagagtgagaaaggtttaaagtagttaaggtttaaagataattttcgattttatttttttaaatgttagtttttaagattttaggttttttggattttaatttttatgttattttaaaggttttaaattttagttttagtagttttagtttatagttttaggtttttagagattattttagtaatttttaaatattattttagggatttagttttgatagttaagattattttttttataaaataatcgtagatattaggtgaagatttttaaagttttaaggaaattttaaattttattttgaggatatcgattttattaaagtttcgaggaaattttaaattttatttcgaggatattagttttatcgttaggaatcgggattttaatttatagtattcggatttcgagaatagaggtttcggggttaaatgggttgaatttagtattttatttttacgttttcgggtggatagtaatttttttttatcgcgttttttcgtgggttttaggttttatatttgagggatgtggttttttttttttatattatgttggttaagaatgatttatatagttattatggaatattgtatggagataaggagtggttgtgtttttgtttgaagggtttattttatttatgaggtaggatgatttttaaggtagtgttatttattagagttaaagtttaggtaaggtgtttaggggttagttgtaatatgaagtatattagttaaggtagttttaaagagtattgttagaggaagaatttatatttggttgtttaatgaggttgaaaggtaaatttaggttaagtaggttaagtaaagaggttagtttagtattttgggaggtagaggtaggtggattatttgaggttaggagttcgagattagtttggttaatatggtgaaattttgtttttattaaaaatataaaaattagttgggtgtggtggtacgcgtttgtaattttagttatttaggaggttgaggtaggagaattgtttgaattagggaggcggaggttgtggtgagttaagattaggttattgtattttagtttgggtgatagagtgaaatttcgttttaaaaaataaataaataaataaataaaaataaaaaagaagttagaaagtttatgaaaaatatttggagggaagaagttagtttaagaataaaagtattaggttagggcgtttaagatttttaaggattggttttggttgtgtagatatttaaagagattgtgtaaggttggataggagggtgagttggttaaaaaggtgatttgttaattgtggaattaattatcgtttaatgttttggataattgagtttgattcgtaatggttaggtttattattgtaaattagttttgaagtataaataagtttattaaattattttttttgtttatatttttttttattttttgatttatgtaatttttgtagtttatatttaaataaaaaataataatatggatttgttattatgtatgtcgtggtttatttttaattgtaaagtttttgattatttttttgttatgttgatttttatgttagaagaaaacgttttgttatttattatgagtgtagaaaattgtttattagaaacgattttaaatagtaaaggatgtatatttgaaataatagggttgtaatgaaaaagtatatattttttaattttatttaatatattgtattcgtagagtaaaagatatagaaaagtattttatgttttaaaaatgtaagtttgagagtgaaaaatagagataataaaaatttttttttaaatattattggtggaaaagttttaaagtaatagaaagtatatataaaatgtttgtgaatttttgtgtaataaaattatatatatatatgtgtgtgtgtatgtatatttgttttttttgttttgttttgtttttttttttttttttgagacggagtttcgttttgtcgtttaggttggagtgtagtggcgggatttcggtttattgtaagtttcgtttttcgggtttacgttatttttttgttttagttttttaagtagttgggattataggcgttcgttattacgttcggttaattttttgtatttttagtagagacggggttttatcgttttagcggggttggtttcgattttttgatttcgtgatttgttcgtttcggttttttaaagtgttgggattataggcgtgagttatcgcgttcggttaatgtatgtatatttgtaatttagatttgtaaatgtagttatatttatatttatatattaaatgtattaaaaagatttattaagttttttatagttagtttataaatttttagtttttttatatattcgtattttttgttttaatatgatataatagttaaaaaaatttaaaaattaataattaattaagttttttttttttgtagattatattagttattatttagaaatattaatttattgttttaaaaataatttttttagagatgtttggtatttagtatatgaaattatttataattgaataatataaataaaatagaaaaaagaatttatttttgggatatttgaagaaagtgatttataaatttagtttatttttgagttttattatttttaggaaaatggtttttatgttatttttatgttatgtttgatttgttttgtttgagtttgttttttagaaagattgtgatttttggtttgttgaatatgaaatttatatgattatttttgggaaaaattttttttttagtgattgtaagttaggttttgtggtcgagaagtattagttgtatttggttgattgattgtattattttgtttttatgttgtttataaagatatatttgagatttggtaatttataaaagaggtttaatagatttatagtgttaagtgggtgggggtgttttataattatggcggaaggtgaaaggtatgttttatatggtggtagataagagaagagagtttgcgtaggaaaatttttttttataaaattattagattttatgagatttatttattattataagaatagtacgggaaggatttatttttatgatttaattatttttaattaggattttttataatatgtgggaattatgggaattataatttaagataagatttgggtgaggttatagttaattatattattgatttttattatattataaagaattattttgtagagagaatttgttttttatttttaataatttgtttattttggatattttatataaatagagttatataatatttgttgttggtttttttatttagtgtaatgtttttaaggtttatttgtgttagagtatgtatttttgttttatttttttatattattaaataatattcgattgtatggatgtgttatattttatttgattttttattagttgatagattgttgggtttttttattttttggttattacgaatgatggtattatatgaatatttatatataagtttttatgggtatatgtttttattttttttgggtatatatttaggtgggggattgttgttatatggtaattttatgtttaatattttgagga

SEQ ID NO: 303 - DNA, 6499 bp, Artificial Sequence
  chemically treated genomic DNA (Homo sapiens)
tttttaggatgttaaatataaagttattatatgatagtaattttttatttaggtatatatttaagaaagataaaaatatatatttatgaaaatttgtgtgtgaatgtttatatagtattattattcgtaatagttaaaaagtagaaaaatttaatagtttgttaattgataagagattaaataaaatgtggtatatttatataatcgaatattatttagtgatgtaaaggaatgaagtaaaggtatatattttaatatagatgaattttgaaaatattatattaaatgaaaaagttagtaataaatattatataattttatttatgtgaaatatttagaataaataaattattagagatggaaagtagattttttttgtaagatagttttttataatatgatgaaagttagtgatatggttggttgtgattttatttaaattttattttgaattgtagtttttataatttttatatgttgtggagggttttggttggaggtaattgaattatgggggtgggtttttttcgtgttatttttgtgatagtgagtaagttttatgaggtttgatggttttataagaggaaatttttttgcgtaagttttttttttttgtttgttattatgtgagatatgttttttatttttcgttatgattgtgaggtatttttatttatttgatattgtgagtttgttaaattttttttgtaaattgttaagttttaggtatgtttttatgagtagtatgaaaatagagtaatatagttagttaattaagtatagttgatgtttttcggttataggatttggtttgtagttattaaaaaaggaattttttttaagagtgattatgtaaattttatatttaataggttaaggattataatttttttggaaaatagatttaagtaagataagttaaatataatatagagatgatatagagattatttttttaaaaataatgagatttagggataaattgagtttgtaggttattttttttagatgttttaaaagtaagtttttttttttgttttgtttgtattatttaattataaatgattttatatattaagtgttaaatatttttagagaaattatttttaaaataatgaattaatgtttttgaataatggttgatatagtttataagaaaaaaaaatttggttaattattaatttttaaatttttttaattattatattatgttaagataaaaaatgcgaatatgtgaagaagttgggaatttatggattgattatgaggaatttagtgaatttttttggtgtatttgatgtgtggatatgaatgtggttgtatttataaatttgagttataaatatatatatattggtcgggcgcggtggtttacgtttgtaattttagtattttgggaggtcgaggcgggtagattacgaggttaggagatcgagattaatttcgttaaaacggtgaaatttcgtttttattaaaaatataaaaaattagtcgggcgtagtggcgggcgtttgtagttttagttatttgggaggttgaggtaggagaatggcgtgaattcgggaggcggagtttgtagtgagtcgagatttcgttattgtattttagtttgggcgatagagcgagatttcgttttaaaaaaaaaaaaaaaaataaaataaaataaaaaaaataaatatatatatatatatatatatatatatatgattttattgtataaaaatttataggtattttatatatattttttattgttttgagatttttttattaataatatttagagaaaggtttttattgtttttgttttttatttttagatttatatttttaaaatataagatgtttttttatattttttattttacgggtataatgtattgaatgagattgagaaatatgtatttttttattataattttattattttaaatatatattttttgttgtttagaatcgtttttagtaagtagttttttgtatttatggtgaatagtaaagcgtttttttttgatatgaagattagtatgataggagaataattagaaattttatagttagaagtaaattacgatatgtataataataagtttatgttattattttttatttagatatgagttatagagattatatgaattagggaataaaagaaaatgtaaataggaggggtagtttaatgaatttgtttatattttaagattgatttataatggtaagtttaattattgcgagttagatttagttatttaggatattgggcggtggttgattttatagttagtagattatttttttggttagtttatttttttgtttagttttgtataatttttttaagtgtttatatagttaggattaatttttggggattttagacgttttgatttaatgtttttatttttggattaattttttttttttaaatgttttttatgggttttttgattttttttttatttttatttatttatttatttattttttgaggcggagttttattttgttatttaggttggagtgtagtggtttgattttggtttattataattttcgtttttttggtttaagtaatttttttgttttagttttttgaatagttgggattataggcgcgtgttattatatttagttaatttttgtatttttagtaaagataaggttttattatgttggttaggttggtttcgaatttttgattttaggtgatttatttgtttttgttttttaaagtgttgggttgatttttttatttggtttgtttgatttagatttgttttttaattttattaaatagttaggtgtagattttttttttggtaatattttttgagattgttttggttaatgtgttttatgttgtaattggtttttaaatattttatttgagttttgattttagtgagtagtattgttttgagggttattttgttttatgaatgggatgagttttttaggtaggggtatagttattttttatttttatgtaatattttatgatgattgtgtagattatttttggttaatatgatataaaaggaggaggttatattttttaaatataggatttaaaatttacgaggggacgcggtggaggagggttgttgtttattcgggggcgtgggagtgaggtattggatttagtttatttggtttcgaagtttttgttttcggaattcgggtgttgtgggttgaggtttcggtttttaacggtgggattggtgttttcgagatgaaatttggggttttttcggggttttggtgggatcggtgtttttaggatgagatttagggtttttttggggttttggggatttttatttaatatttgcgattattttatgagaggagtggttttggttgttagaattggatttttggggtgatatttgggagttattggagtgatttttgaagatttagggttatgagttggagttgttggggttgaaatttggggtttttgaagtggtatggagattgaggtttagagagtttgagattttgagggttgatatttggagagatggggtcgagggttgtttttgggttttgattgttttgggttttttttatttttattttcgggatgttttgttagaatttttgttggattggtcgtaattttgtttcggagcgggtttatagggtttgaaggttaggtacgaggtaaaggtaaagatttaattgatataggttatgatagaggtgttgatttcgtgtttaaaatttttgatttatttatgtaagttttgttttaatttgtttttcggagtattaatgttttttttaaaatttttttttttttgtaatttatataaatagtttatttttttaagtaattaaaattttttatgaatatttaagttgtttagtttttaggagaggtttagtaaattaaagttgtatgggatttgtatgagttacggaaagatgcgatatttaattttgtattgaaacgtttttttttgggaaaagtataaaacgttaaattgtaaagattttgttgtaataaagtgtatatataaattttttttttgtgatggtgaattttatacgttaatttatttgagttatggtgtttagatatttggttgaatagtagtttaaatgttgttgtgaaggcgttttttagttgggattaatgtttaatttagtagattttgagtaaatcggatttttttttataatgtttgtgttttatttaattagttgaagattttaagaatatagattgaggttttttaaagaatatgaaattttttttaagattgtaatttagaaattttgtttgagtttttagtttgttgttttgtggattttcgatttaaggttataatatttatttttatttgaatttttattttgttagtaaattttatagatgtaggatttgtagtttttataattatgtgagttaattttttaatgtaaattttttttattttttttttgttatatttatagatttatttgttatatttatttatgtattatttattatttattatttattatttatttatattatttattatttttatttatttatttatttatttatttatttatttatttatttattatttatttaatatatttattttattggttttgtttttttatataattttgattaataaatttattaaattttaagaagtttttttattttttttaggtgtagtatatattttttttgttataggtgagaagtgttaaggttgtaatttgttgtttttattagaggatgggattggtttacgattgtatttttgttttttgattatgtatgtatagggttttttttaagggtttttaaatataaatttattagatttatttttgcgtttttgtattgttaatttttttattaatattatttatttatatattaattatatatgcgtatgtatatatgtatatatatataataaaaaacgaaagttatatttgtgttatatttttggaaatgatagttgttgttttgttttttcggggtagggtgtttgggtttgttaaatattgagtacgtggtaatagtttatttgtgtttgtttttataatatgttgttttatagtaattttcgcgtttttattttagtaagttttagtattattttagggagtcgttaatgtttagaagaattttatttttttagggtattttatagtagtattttttaaattatttgtgttgaaggatttttttatttttagtttgtagatgaatatttttaaaaaatataaaatatgtattacgatattgtagaaatgttaagttgttataaaagttttaaaagtagatttttatttttttattatttttttattgattagaaagtaattatgttttgaatagaattgttttaagtgtttaatatagagtggttgaggatggtgtttagggtaatagatagtattgattagggaagattgtgtaggaggatgtatattttggtggggtttatgttttatattatttgtatttttaggttcgttatgaacgaagtttttaaaataggaaatatttttttgtattttagttttttttatttaagtatatttattttatttttatttagtatgtttgttttattaattgtaattattttataatttaggttattttgatttttttagatgattaatgatgggaagttgaagaagataggttatgggtttttagtttatttaaagtttatttaaattttagtttagagggagatttttttttttatttcgtttaaatatattatggtttttttatggtaattgtgaaattagtttatatatttaattattttatatttgattatttatttttatgtattatgaatagagaaggtggaattaaatttttattttataataagaaggaggttgagattggaaattttatatttaatatcgttgtaattttttttttggatatattagttcgatatagttttatatatgtgtataaggagttaatgttatttttgatataatttttatattgttaaaaagtatagaaatattgaggtttaaaattttattttattttaatagtgtaatgtttttaaagaaaaaatgtgagggttaagttttattttttattttattttatttatttatttttttgagatagagttttatttttgttgtttaggttggagtgtaatggtgtaatttcggtttattgtaatttttgttttttgggtttaagagatttttttgtttaagtttttcggaattaagttttttttataggaaaaaaggaatttgattgtttttttatattaaattagtgtaaatgaaatgatttttgtaattataaataaattattttttaattgtgttagatatattaatttttaaaggtttttatttgttgatgtaattaaatggttaaatattatatagaatttaagtgggaataataatgtgttaaaatatatttatgtttatgtgtatttaatgattagttgttagttataagtgagaatatgtagta

SEQ ID NO: 304 - DNA, 4441 bp, Artificial Sequence
  chemically treated genomic DNA (Homo sapiens)
ttagtataaggtttttgttaagtttatggtttgaaaattttgttttttttcggatttgaaagtattttggttttcggatagtatagaaaaattaaatagttagaaattgaataattatagtataatttaggaggtttgttagtttgattgagttttattaattttttaatcgtaagaaggaataaaatatatttgttggtttttatgtcgtggtttgttttagagtagttatttaagtttatattttatgttagaatgagaagtgaattatttggggataaacgaggtgtgtatttgtttaatagtttagtgattttttggaatttaaatattaagtgaaaggatagggttatagggtagttgatttttggttcgtttttttttcgtttgtttatggttttgattatgttatatttttttttgtggttagggttttatagagaattttagggttatggtttgttgtttagttaagaggtataaatttgttgtttaaatatgtgaagtttatagtttgggggttgggagttaaaggggaggtagttttatacgttttattttttttataaaatttaaagtagattaaataaaatcggtgtgaaattttatgatttgatgttgtcgtggttatattttttaagttgtaatttatttatttgtatgtgtgtttatttttaggatttatagttcgtttagttttcggggggaaagagaatatttgaaattttttgtaaagggtttgaagtatgtagtggtttgtgattaaagtttaggatagagtgtgtgtgtgtgtgtgtgtatgtgtgtgtgtgtgtatttatgtgaatgtgtgagtgtttatttttgtggggttttttttttttatttgttgtttttacgtaaaagtattatatatggtagtatttaggagtttttttatagttgaagtgttttaaatattaatgaatggaagtttggttatataatgtagataagttttaaggtatgttttattgaatggtgtattgtagtgatttgggaaaggaagagaggtataaattgtgtcggttagttatttagataaaatgaagttatgtggaaaattaaatttattaaagtatgaagattgttataagttgttttaagttggttatttttaaaggggttcggtttgttgtaggagtaaatgtttatttttttttttagattttttttatatgtcgttttatgagataatgtgtagtatttgataaaaattatttttttattaacgacgtttttatcggaaatgtttattgttttcgttttattatttatgttttgaaaggtattgtatatttgttaaataagtaaaaggaaagagaattttgcggtttaagtcggttcgtagaaattttaataaattttagagttataaggaattagaaaaaggaaaagggaaggaggagttagatttatatgaagagggggttttgtaaaaatatatatattagattttttttgtttggttagtttattattaaatgtttggtcgatgcggattagtattgagattgagtagttaacgtcgaatttgggttattgttttaaaatgtgttttaataaatataagggggaggaaatggatttgggaaggttcgttgttagttttgtttttgtttttatattgtttttgtatagtggtgtaggggttatatataggtgttggtattagtattaattcgatttaaattttggttttatatattttgtaattttgggtatattatttgtttgtgttttggtttttttagatgtaaaataggaatattaatagaaggtgtttaagtatttggtaagtattttaaaaatattagttattattattagtatttggagggtgggtttatttatattttaagaaaggatttttttaattttattttttttgtgtgtcggtttttaaaattgatgaatggtatgttgtcgggaaaaatttatttatttttattttttttttaattggtgagtaagcgtgtattgttttgatattttttggatagtaaataattgaatttgttgattagtcgttatgatgttaagttttaagttaatagtggttaatgatcgttttgggaaaaaataatattttgattttttaattacggtttaagaagttttgggaatgagggttcgttagttatcgttatttttttttgaggtaagtataatgtgttgtggaaataggttatttttgtattgttggtaagagtagtttatatagtataacgattgagcgttatggttgtgttttttgtgtgttttaggaggaaattgaagagatatttttataagagtttgtcgaagaggattagggggcgttaacgttcgatttttattttagtagtagttggattttttgaagggagaagatattgtagtgattatttattttgtattgttatggtttttttatttttatttggggtggggtggggtggggtgggggaggggggggtggggtggggagaaattatataattttaaaaaggattatattaattattttttttgtaatttttttatagttttaggtttagtgaaaaattgttgtaaatataggggatatagtttaataatgtaatttttaattattgttttttttttttttaatttattaatagtttgttgatttgataagtaagagtgggcgggtgagaaaaatcgaattgggtttagttaattattgtattgtatgtaaataagaaacgtgttatatttgtgacgtcgggtatttatataggaagaacgcggtgtgtaatattgtgtatattttaaatattattttaatttattttttgtagtgaattttttgtttagaatattaaagataaggattagatattattttttttttttcgtataattttgtagatatttatttgatgatttttaattttttatttttaaatgagacgaaatgttgatgtatttttttatttagttaataaattagaaaaggttatgtttattttttaaaaagggaagtaagtaaataaatattgttaatttttttatttatggatattatatatattagtaggagtaataaatttatttatagtatttgtttttaggataatattttatttttaggaaatttattttttatagagttaaaatgttatttagtaataaataatatttgttagttttagagtatttaaggaaattagataagtaaaattattttttttgtaatttaatgaaaaggtataatagaataatgtatgatgaatttatttaattatgaggtgggaggagcgaaatttaaattttttttgttatagttatatattaatttaaaaagtaaaaaaaaaaaaggggggggtaatttttttttgtgtttttttttttttttttttttttttttttttttttttattgtgtattagtttttatgaaagatttgaatattatttattttaaattaagtatatgtgttattttaagtaatacgttttgatataagatggttgattaaggtgttttttttcggtttgagtttattatttttttatttaaattgtatttttagttagagatgtaatatatttttattatttaatattatttttgaatgttataacgaatttatagtttagtatttattatatgttgttatatataagtaatgtaagaaaaaaatttattgggtaggtgattttaattatttgtagttttttttgtatatttaattatagttaaagaagtaatttttttattgtgttttagtatgattatgtatttttttatgtttttttaattaaaaatttttaaaatatttgttttagtttttttgttagatttttatattaatttgaaaattttttaattaagtcgtttttaggtttttaaggataattttttttaattatattatatattatataagatttgattgtaatatttaaatattattttttaagtttgtattttaaatgaattttttaaggagatggattaattgatttgtaaagatttatttttagattttaaaaggaatgaatttgttatttgtagtatttatttgtttttttaatgtttgaaatagtttaaattgtagttaattttagttaaaattatttttgtaaaagatatttgatagaaaggaatacgtttttatatatttttgtaaaataagtaaataataaataaaataaaagttaatttttaaagaaatttgaagttttgtaggtgagatgtaataagttttgtttttgtataatgtaattaaaaatatgtgtttttaagattagttgaatataagaaaatgtttgataaatatttttatgtattttatataaatgtgatttttgtaatatgttttaattagatttattttaaacgttttttatgtagagtttttatgttttttttttttagtgagtgtgttgattttttaatatggtattattaattg

SEQ ID NO: 305 - DNA, 4441 bp, Artificial Sequence
  chemically treated genomic DNA (Homo sapiens)
tagttgataatattatgttaaaaagttagtatatttattaggagagaaaggtataaaaattttatataagaagcgtttaaaataaatttggttgagatatattataaaaattatatttgtgtaaaatatatgaaaatatttgttaagtatttttttatatttaattaattttaaaaatatatatttttgattgtattatgtaaaagtagggtttgttgtattttatttataaagttttaagtttttttgaaggttggtttttattttatttattatttatttattttgtaaaagtatgtaaaaacgtgtttttttttattaaatgttttttataaaaatagttttgattagggttagttgtagtttgaattattttaaatattgaaaaaataaatgaatgttgtaagtaataagtttattttttttgaagtttggaggtaggtttttgtaagttaattagtttatttttttaaagaatttatttgaggtatagatttggagggtaatatttaaatattatagttaaattttgtgtgatgtgtagtgtgattgaggaaaattatttttaagaatttaggagcgatttggttaaaaaatttttaagttaatgtagaaatttagtagagaagttgaaataagtattttaaaaatttttaattaaaaaaatatagaaaaatatatagttatgttgaaatatagtaaggagattgtttttttaattgtaattaagtgtataaaaagaattgtagatgattagaattatttatttagtaagttttttttttgtattgtttgtgtatagtagtatgtaataagtattagattgtaaattcgttgtaatatttagaggtagtattgagtagtggggatatattgtatttttggttaaaagtgtagtttgaatgaagagatggtgaatttaagtcgaagaaaagtattttggttaattattttatgttaaaacgtattatttgaagtaatatatatgtttaatttgaggtaagtggtatttaggttttttatggaaattgatatataatgaaaagagagagggagaggaagagagagagagaaagatatagagagagattgttttttttttttttttttttgttttttaaattgatgtataattatagtaaaagaaatttagatttcgttttttttattttataattaggtgagtttattatgtattattttgttgtatttttttattaaattataaagaggataattttatttgtttagtttttttaaatgttttgaggttgataagtgttatttattgttaaatggtattttggttttgtaggaagtagattttttgaaaatgaagtgttgttttgaaaataagtgttgtgagtaaatttattatttttgttgatatgtgtgatatttataaatagaagagttggtaatatttgtttgtttatttttttttttgaaaaatgaatataattttttttagtttgttagttgaatgaaaggatatattagtatttcgttttatttagaaataaaaagttaaaaattattaagtaagtgtttataagattatacgaaaaagagaaagtagtatttagtttttatttttggtgttttaaatagaggatttattatagggagtgggttggggtggtatttgaggtgtatatagtgttatatatcgcgttttttttatatgaatgttcgacgttataagtgtgatacgttttttgtttgtatgtagtgtagtgattgattaaatttaattcggttttttttattcgtttatttttgtttattagattaataaattattagtaggttaagaaaaaagaaaatagtaattaaaagttgtattgttaagttgtgttttttgtgtttatagtagttttttattaaatttgggattgtgaagggattataaagaaggtgattaatatagttttttttaaggttatgtgatttttttttattttattttttttttttttattttattttattttattttagatgaaagtggaaagattatggtaatatagaataagtggttattgtagtgttttttttttttaaaagatttaattgttgttgaggtagaaatcgaacgttggcgttttttagtttttttcggtagatttttgtgaggatgtttttttagtttttttttggaatatataaagggtatagttatgacgtttaatcgttatattgtgtgggttgtttttgttaatagtgtagaggtaatttgtttttatagtatattatgtttgttttaaaagaggatgacgatgattggcgagtttttatttttagggttttttaaatcgtaattgaggaattaaggtgttgtttttttttagagcggttattagttattgttgatttaaggtttgatattatggcggttggttagtaaatttaattgtttgttgtttagagaatgttagggtaatgtacgtttatttattaattagaaaaaaagtaggaatggataaatttttttcgatagtatgttatttattagttttaaaaatcggtatataagaaaaatagagttagggggatttttttttaaggtataaatgaatttattttttagatattggtaataatagttggtatttttagagtgtttattagatgtttaggtattttttgttaatatttttgttttatatttgagaaaattaaggtatagataagtaatgtgtttaaaattatagggtgtgtgggattaggatttgggtcgggttggtattggtgttaatatttgtgtgtgatttttatattattgtgtagaggtagtgtgagagtaggggtagagttgataacgagtttttttaaatttatttttttttttttgtatttattaaagtatattttgagatagtgatttaagttcggcgttaattgtttaattttaatattaattcgtatcgattaaatatttgatggtgggttagttaagtagagaaaatttaatatatatgtttttgtaaggttttttttttatataaatttaatttttttttttttttttttttttttgattttttatggttttggaatttgttggggtttttgcgagtcggtttgagtcgtaaagttttttttttttttgtttatttaataaatgtgtagtattttttaggatatgggtggtaaagcggagataataaatattttcgataaaagcgtcgttagtgagaggatgatttttattaaatgttgtatattgttttataagacggtatgtgaaaaagatttgggggaagaggtaaatatttatttttgtagtagatcgagtttttttaagaatggttagtttaaaatagtttataatagtttttatattttaatagatttgattttttatatggttttattttgtttgggtggttaatcgatataatttatattttttttttttttttaggttattatagtatattatttagtaaagtatgttttaaagtttgtttgtattatatgattaaatttttatttattagtgtttgaaatattttagttgtgaaggggtttttaaatgttattatgtgtgatgtttttgcgtaaaagtagtaaatgggagaaaaaaattttataagaatgggtatttatatatttatatgaatgtatatatatatatatatatatatatatatatatattttattttgggttttaattataggttattgtatattttaaattttttgtaaaaggttttaaatatttttttttttttcgaagattgagcgagttgtaaattttgggaataaatatatatataaatgaatggattatagtttgaaaaatataattacggtagtattaagttatgagattttatatcggttttgtttagtttgttttgggttttgtgggaaaagtggaacgtatgaggttattttttttttaatttttaatttttaaattgtgggttttatatatttaagtagtaggtttatattttttgattaggtaataggttatgattttgagattttttgtggagttttggttataaaggaggatgtagtatgattaaagttatgggtagacgaaagagagacgagttaaagattagttgttttgtgattttgtttttttatttaatatttaaattttagaaagttattaagttgttaggtagatatatatttcgtttgtttttagatgatttattttttattttgatatgaggtgtggatttaggtgattattttgaaatagattacggtataaaagttagtaagtatattttatttttttttacggttaaaaaattgatagaatttagttaagttggtaaattttttggattgtgttgtaattatttaatttttaattgtttgatttttttatattattcggaaattaaggtatttttaaattcggaaggaaatagaatttttaggttatgaatttaataaagattttgtattag

SEQ ID NO: 306 - DNA, 4343 bp, Artificial Sequence
  chemically treated genomic DNA (Homo sapiens)
tttaaagaattattaaattattttttgggtttttgaattagatggagttgaattattttggttgttaattgagtgaagggtgttggggaaaagtgttattgtgtaagttaaggaaagggttagagaatcgaaaagacggtagttgtatgaaagggtttttgtgttgggattttttttttaagttatttaaaggtataaattaagaatcgtaattttggagatatgataaatgaatataattttggttttttgttttattttaaagtgaaattttattgttttttaagaatttgtatatgaagttttatatattttttatgttagtttttttttttgttatttttgttttttagtttgtttttttttaatagttggatatattatcgttttatttttttattagttgtgattgaagtagtttgaggttaattatttttttagtaattgataaagaattttgatgaagaggaaagtgatattgttttttgaataatattgtttttttttttttttgttttttcggttgagaggagagagtagggtagattttttttttgtaaggagtttagtagggcggtggcggtggggtttgtggaagtgcgtgggtaatatatggtaagtggagaaaatatttatatttatggtgaaagagtaggagaagatttaaagaaggttattttatagagattttaagtaagagatattgatttgatattgtatttttgatttggatataatagagaatttaaagaaagagtttttttttgtggtttttttgttatcgttatttttaataattcgaattattggtaatttaaaaaagaaaagatttcgtttattaaatttgataaaagtattatattggttttttttcgggttttggttaggttgttacgtttttttttttttttttgcgttaggtttttaaatttagaattcggagtcgcggttattgagtttgtgttttgggtttgcgggcggtgtttgttgttgtgattgggcggttaggtgagacggagcgtacgggtagagtgcgtatttggggcgattggtttttgggggaagatataaataatgaatcggtgttagattattttttgatgagatatatgaaatttttagtgtttttagtaggtattttgtattatagttttttaagaaaggtaaaaggttttttttcggttttttagtggtaaaattcgtagttgtcgtttagtattataattaaatgcgtgcggggttgcgggatagaggcgttttcgcgtattttcggatagatttatagttgtttggcggatatatacgtgcgcgtttggtcgatcggattagtagttgtttgcgttttttttttcgcgtacggtggcggtttcgtattaagattcgttgaggaaacgaagagtagggttattttttattttgtcgtcgaaagtttattttatttttcgggtgtgtaggaagagatggcgcgagggtaggaaggtgtgaaattggggttttgcgggagatttatcgtggttttatatttattttcgtttgaaaattgttagcgttttattttttttaaattttagttttcgagggggaggtagtgagatgggatataggtgcgtttgggttttcgtttgggaggggtttttttattttgggatttttcgtggagtagtttataatcgatcggtttgttgtatagaggttatgtttaatggattttcgtagataaaagggtttggttattttttttttttataatggtttttgaggttaatgttttaaagaggaaataaagggattgttttatagtatataaggggggtggcgggaggaatagggagaggaggaggaaggggtattggatacgcggagcgggaggaggtttttcgttttttaattttttattttttgcgatcgtttaggtttttcgagtttcgtatttttatttaggattcgaaatagcggggaggaggcgatagtgcgtggagggtttcgttttgtgattcgatttttagttttttttattttttttttcgtttttttaaagaatttttgaaagggagaacggaaaagatgaggggatttatatttcgtgagttgtagttttgaaaagttagttttagaggggtcgtttttcgcgaggttcgggtgtttatataggatcgacgcgtggtagtgttatttgggttcggattttgggattgcgggaggcgggagcgtttggggttaggatttgggcgtacgttgagggtattcggtgaaggtcggggaaagtggggtagtttcgaaatgcggtttgtacgtcgttttgggagtcgttttcgggtttttttgtagatatagtttttaggtgtgagcggtgtgtgcgtcggtcgggggcgttttttataggaagtttatatttgtaaattgggcggtgggggggggggggggcggggcgcggcgggagagagagagttttagtggtttttgttttttggtttttttgttttggttttaggaaaagattaaaataatagttaaatagtaattgaagataagtgatgtaagaaataaataattcgataataaaaatgtttatagggacggttttttaaaattttttattatggaaattagagtatatgtataaaaggagagagaaaggtattgtgtagtgggttttaaatttgattaagtattcgaatcgcggagcgaaattttttggagggtttgttaaaatatagattgttgggttttagttttagagttttttgttgtgtatttttaagtagatttggggttagtttttttttgagaatttgtaatttgttagagtttttaggtggtgttgtttttggtttggaaaggatattgttatttattggtttaataaattttcgcgtatttttttttatttttaatatgtataatatttttttattttgtttattttatttttttttatattttgtttggtttgttggagaattataaagtaatttttagttattttattattttatttatatagatgatttttgattcggtggttatttaagtcgagaggattgtaggtttttttgtggttattttatattggggtagaatttggtatttttttttgggaaatttatgtttatattttggttttgagattatttttcgggagtttttttttagtagattgttatatgtttaaatattattattgggtttgttggtaagttggtttggtttggttagggtattatttggtttttattttttattttttgtttattgtttttaatttgttattatgtatttttataattatcgttttttttgaggtatttttttaataaggcgttttttttttagggtggagttttgagtgtttagggatggggtggtatttataatagtgtaagtttataggattatttgtattagttaggtttaggatttatattttaaggggagtttttttgggttatttgatttttcgtataatttttgattggaaaaggggatattttaggtatagtttttgggaatggttattattgatatttgtcgtaattttttttgattgtcgggttttagtttagtttggttatttgtgttgtttttgttttagagaggtgttaagtgtttttttagattttatttggttagttttaagtgtgtagtttttatttatttttttgttttttttttgggtcgtttcgaaataagttttttttttttttttttttttttttttttattttggtttaggatattatttgttttttttatagtttttttattttagttttttttagttttatttttattttaatttttagaggttttttgggttgttataaagtttagatatttttttttattttttaaatttttagagatggggtgttatttattgtgttatttaggttggagtgtagtggtgcgaattcggtttattgtagttttaattttttagacgtaagcgatttttttattttagtttttaagttattgggattataggtacgtattatataggtttgttaattgttgtatttttttttttttttgtagagatagggttttgttttgttgtttaggttggttttgaatttttgagtttaggtaattcgtttgttttggttttttaaagtgttgggattataggtatgagttattgtgttcgatttagatttttttattgttttttttttttttttgattttttatgaagtaagtatattatatgaattttttatttttttatttgttgttaaagaaagtttcggggatggagtaggtttttttattttagagttttgtttttatttttatattgttttatttttttatgtttttttttttttattagtttggaa

SEQ ID NO: 307 - DNA, 4343 bp, Artificial Sequence
  chemically treated genomic DNA (Homo sapiens)
ttttaggttggtgaaggaagaaaaatataggaagatgaggtaatatgaaaataggaatagagttttggggtggaggaatttattttattttcggggttttttttaatagtagatggaaaaatgaagaatttatatagtatgtttgttttatgaagagttaggaaaagaaagagaataataaaagagtttaggtcgggtatagtggtttatgtttgtaattttagtattttgagaggttaaggtaggcggattgtttgagtttaggagtttaagattagtttgggtaatagggtaaaattttgtttttataaaaaaaaaaaaaaatataataattaataggtttatgtggtgcgtgtttgtagttttagtgatttaggggttgaggtgggaggatcgtttgcgtttgggaggttgaggttgtagtgagtcgaattcgtattattgtattttagtttaggtgatatagtaagtgatattttatttttaaaagtttaaaaaataaaaaaaaatgtttaaattttgtaatagtttaagagatttttgagggttgaggtggggataggattgggaggggttgggatgagaaagttgtggaaggagtagatggtattttaaattaggatggggaggggaggggagggaaagaagggaagtttgtttcggagcggtttaaaggagaggtaaggagataggtagaggttgtatatttaggattagttaggtggagtttaagagagtatttggtatttttttggaatagaagtaatatagatagttagattgagttagggttcgataattaagggaggttacgatagatgttagtgatggttatttttagaagttatgtttagaatgtttttttttttaattaggaattatgcggagggttaagtagtttagagaagttttttttggggtgtgagttttggatttaattgatgtaaataattttatgggtttgtattgttgtgggtattattttatttttaggtatttagaattttattttggaggggagacgttttgttaggaaaatattttaggggaaacgatggttgtgggagtatatgatgatagattggggataatgagtagaaaatgaaagatggggattaggtggtgttttgattaggttaggttagtttgttagtagatttagtggtgatgtttgggtatgtgataatttgttggaaaggaattttcgaagggtggttttagaattaagatatgggtatggattttttagagagaggtattagattttgttttaatgtgaaatgattataaggaagtttgtagttttttcggtttaagtaattatcgaattaaaaattatttatataggtgaaatgataggatggttgggaattgttttataattttttagtaaattaaataaaatgtgggaggggatagaatgaatagagtggggaggtgttgtatatattgaaggtgggagagggtacgcggagatttattggattagtggatagtagtgttttttttaaattagaagtagtattatttgagggttttaataagttgtaaatttttaggagggagttgattttagatttgtttaaaaatatataataaaaaattttagggttagggtttagtaatttgtgttttaataagttttttagaggatttcgtttcgcggttcggatgtttgattaaatttgagatttattgtataatatttttttttttttttttgtgtatgtgttttgatttttataataaagggttttaaaaaatcgtttttatgggtatttttgttgtcgagttgtttattttttatattatttgtttttaattgttatttaattattgttttgatttttttttggagttagaatagaaaagttagaaagtagaagttattgagattttttttttttcgtcgcgtttcgtttttttttttttttatcgtttagtttgtaaatataaattttttgtaagagacgttttcggtcggcgtatatatcgtttatatttgaaggttgtgtttgtagaggggttcgggaacgatttttagggcgacgtgtaggtcgtatttcggagttgttttatttttttcggtttttatcgggtgtttttagcgtacgtttaggttttggttttaggcgttttcgtttttcgtagttttagagttcgggtttaggtggtattgttacgcgtcgattttgtgtgggtattcgggtttcgcgagagacgatttttttagaattgattttttagaattgtagtttacgagatatgggtttttttatttttttcgtttttttttttagaagttttttaaaaagacggggaaggaggtgaggagagttggaggtcgagttatagggcggggttttttacgtattgtcgtttttttttcgttgtttcgggttttggatgagggtgcggagttcgggagatttgggcggtcgtaggaggtgaagggttaagaagcgggaggttttttttcgtttcgcgtatttaatgtttttttttttttttttttttgtttttttcgttattttttttgtgtgttgtaaaataatttttttgttttttttttaagatattagttttaggggttattataggaaagaaaggtagttaggtttttttatttgcgagaatttattaagtatggtttttgtatagtaggtcggtcggttatgggttgttttacgaggggttttaaagtgggagaattttttttaagcgaggatttagacgtatttgtattttattttattatttttttttcgggaattggaatttagggggagtggaacgttggtagtttttaaacgagagtgaatatagagttacggtgggtttttcgtagaattttagttttatatttttttgttttcgcgttatttttttttgtatattcgggaaatgggataaattttcgacggtaagatgggaaatgattttatttttcgtttttttagcgggttttggtgcggggtcgttatcgtgcgcgggagaggggacgtaagtagttgttggttcggtcgattagacgcgtacgtgtgtattcgttagatagttgtgggtttgttcgagggtacgcgaggacgtttttgtttcgtagtttcgtacgtatttgattgtggtgttgggcgatagttgcgaattttgttattgggggatcgaaagagggttttttattttttttaggaagttgtgatgtaaaatgtttgttgaaagtattggaggttttatgtgttttattagaaaataatttaatatcgatttattatttatatttttttttaagaattagtcgttttaaatgcgtattttgttcgtgcgtttcgttttatttagtcgtttagttataataataaatatcgttcgtaggtttaaggtataggtttagtgatcgcggtttcgaattttggatttggggatttggcgtagggggaggggagaaggcgtggtagtttggttagggttcggggaagggttagtgtgatatttttattaagtttagtgggcggaatttttttttttttaaattgttaataattcggattgttggaagtaacggtggtaggaaagttataaaagaaaattttttttttaaattttttgttgtatttaggttaaagatataatattaagttagtgttttttgtttgaaatttttgtggaatgattttttttggatttttttttgtttttttattatgaatataaatattttttttatttattatatgttatttacgtatttttatagattttatcgttatcgttttgttgggttttttgtaaaaggaaagtttgttttgttttttttttttagtcgggagggtagggggaggagggagtagtgttgtttaagggataatgttatttttttttttattaagattttttgttaattgttggggaaataattgattttaagttattttagttataattaatagaaaaatggaacggtgatgtgtttagttgttaaggggaggtaggttggaaaataaaggtggtaaggaagggggttgatatgaaaaatatgtaaagttttatgtgtaaatttttgggaaatagtggaattttattttaaaataaaataaaaaattagaattgtgtttatttgttatatttttaaggttgcggtttttgatttgtgtttttggatagtttaaaaggagaattttagtatagaagtttttttatatagttgtcgttttttcggttttttgattttttttttaatttatataatggtatttttttttaatattttttatttagttagtagttagaatgatttagttttatttgatttaggggtttagggaataatttggtagttttttgag

SEQ ID NO: 308 - DNA, 4476 bp, Artificial Sequence
  chemically treated genomic DNA (Homo sapiens)
tttttaatttttattttaagaagatttagagtaataacgtagaaaataagcggtttgaggaggatcgggagttagggcggaaagttagtagtatagttaaggtgtttgttagttttttgttcggtttggagaggaagaagattattttaattttttttacggtgagtcgtatttttcgtttttttttttttttttgcggtggggtttgttttttttaggtagttttttttttaatttagattttgttttttttggttattatttttgtttatagtaggaagtttcgtttttagtagtaaatgtagaattttttttttaatttattattgtttgttttaggtggaagggataggaagtttgttttatgaatttggggggagaatttggttgtagattattttggttttttgatagaacgtttgttttttattttttatagaatagcgttttttttattagtataaatcgaagtaggaattttttatttttggagcgggttagtttcggttaggtttttatttagaatggtaaagataggtgagagattcgggttttgtttgttttattttttaggagttatgttttatagggtgatgtttgttagtagtatcgttttttgtttttgttagcgtattgttttttgttttttggagttttattttggttgtgtttagtttagttttttttttttttattttacgttattgttttttttttatttttttttgattgttatttgtagtttgttaagtgtggggttgatcgtggttattttagttatatgttcgttttttgattacggttagggtatggtagttgtttttttttagatatgagtagttaaggttttgtgttgggggttttagtttagggtagaattaagagatgtttattttgaggggtgtatatatagagggcgattttagttatttttatgagattagagttttttagtttttatcggtcgtattttttggtgttgtatttttggttttattttttttgagtttatgaaagtttttttttagtaatattttattttttttgtagaagaaatttttttgtttttaaaatttttaggaggttagtgtagtttggaggtagcggttttttgtttgtttttttttatttttgatttttttttttaggtattgatttatttcgttgtttttcgattttatttatttttattttttagtttcgtattttttagttttgatttgtatttcgttgttgtttaggtttgatttttattttgttagagttttttagttttggttttttttttgtttttgttttttaatttaggtttttcgtttttatttatttttaatacgggttttttcgttgtttttgttttttagtttaattatgttagggtttcgggtttttacggtttttgtttttgtcgtagtttttgcggttcggtttcgttagtattagaaatttatgtcggttttcgtgtattttaataaggtttttgggttgttttttacggagagtaattgtgaggtgtcgcggtttaggtaagtgtgttggggtagttggtgtatttgttgtttttagtttattttatttttttgttttaataattttttttttttatttgggggttttgttgtgtttttgttattttagttataagaaatgggtttgttttttgcggttaggaagtggagggaataaaaaagagtattaatgttttttttttttagtttttttttttagaataggtatgtaggaagttgttttaaggttttaaagggaaatttttttgttttgaattttttagggtttttttagggatttcggggatagtcggtattatagggatttaatttttaagggttggtttttattgtcgttttgagggtttagtttgttcggtttttagggagttcgttgtttttagtttaaattatattttatataggggtttttttttgtttttttttttttttttttaaattatttttttttatttttacgagattttttttttattattgtttttagtagttatatttttttttttgtgttttcgtgatggttgtttttgttttagtatttttttttttgtttttattatagggtgtttaggtgtttagtgatggttgttttgtattttaattcgttttttttaattttatttttttttttatagtatagttttttagcgtgtttttgttgtttttttattcgtttataatattagtagtagtggtggagttttagatcgaattaatttttttcggggtgtgtttagtcgaagtattttttatgttgggtagtttcgataggtgcgggattagtagaatttgttttacggtgtgattttagtttttttttttggttatagttagggtcggcggggggtttttgggagtatttttagtaagtttatttttaagtttgtacgtaggtaagtaaggagttttgggtggtagagaggtttaggttaggtttttttgttttattcggggtgggttgggggttgggggttggggtttgggatattttgtatcggtattgggttttggggttagaagaggttttaggaagtataagaaattaggtttttgttaatattttatgtgtttaggtttattttttttaggtttttttttaattttttataggtattttttattttttggttttaagtagatggtcgatgtcgttttttttttaggagagtgtgaatttagatgttaaaataaaagttttttttttttttttgggtttttatggaaatttatatttggtgacgtagttgtaaagttatgaggtatgagttaggttggggttagtaaggaaaattttgttttggttttttgtttttttgattgttttttttattagttggttttgtttttggttgtaggcgtagttatgtttttttgttcgggggttttagggtgaaatttataaatgaaattattggcgagggtttatagtggttttttttttaatttaatttcgatgtgttaaaggttttttgtgttggatttagggtggggatttttttacggggttttttatatttgagtttttagttattatagaggtgtagtttgaagtgtatttagttaattggttggttttttgggatgtttcgtatttttattttgttatttttttttttgttttggagtagtagtttaggaagtagtaggggttttgagagaataggttcgtttgttttttttttacgttttattttattttgttggaggagttaaagttattgttttattcgagttttagaatgtaagtgtgaggtttgtagagagtgtgggtaggtttgaaagtttgggattttagtttcgttgagcggttttttcgaaaatgggatgatttttgaatttgtaaagttattttttttatttgtttatttatatatcgttttgttggttttttttttatttttttttttattttgttttttttttgtttgtttttttagaaatttgttttttaggtttgttagaaggtaggcgttgagttcgttgtgtgtgtgtgtgtgtgtgtgtgtttgtgttttgtgttttgtttttattattaattttttttttttggtttttatttttttttatttgtttaattaagtttgtgtggtttttttttttttgttattttaaagggatgaagattgtttttgattgggtattagtataaggtttgtttttcgtgtttttagtataaataggtagggttaagaggttatattggtttatttagggtaaatggttttaaaaatgagggttttttttgggtttatagttaacgtttgtttttaagtaaggggagattgttttagggaagtttttttttaagattgtttttttttatttattttattttatttttatttttttttattttaggttttggttataagtgttgggatttttttttgtttttttttttgttatgtgtatgcgttatgaggaagttttagggttataagtgtatttgggatggtattttgtttgttgttttttgggttttttgaattttagagttatgtgatttttttttcgtggtttatgggatcgtaggattttggagatattacggggattttggggttttaaggttttagtttggtttttttagattttaggagtttttgttttataaatggagtatagtatttttttttggtagtttttgtagaattagttttatttattcgtatttttgttttagtatttttgttattagtagtatttggataaattaagtttttttttttttaggttgttttttttagatatggtttgttttttttaaagtgcggggagttgggatattttagggtaacggttattttattttaagtcgtagtaaaataataggagatttttgtatttttatttaggggtttttttttatagttttttttttggtttttttatttttggttttatgtttattttttttgtaggtttcggggattaaatattaagttga

SEQ ID NO: 309 - DNA, 4476 bp, Artificial Sequence
  chemically treated genomic DNA (Homo sapiens)
ttagtttggtatttggttttcgaggtttgtagagaggatgagtataaggttaggggtgaaagagttaggaaggggattgtgaagggagatttttgagtaagggtgtagagattttttgttgttttgttacggtttggggtagaatggtcgttgttttagaatgttttagtttttcgtattttggaagagataggttatatttggagaaaatagtttagaggagaagaggtttgatttatttagatgttgttggtggtaggggtgttggggtaggggtgcgggtgggtggggttagttttgtaggagttgttaggagggggtgttgtgttttatttgtgagataaaagtttttaaggtttgggggagttagattgaaattttggggttttagggttttcgtagtgtttttaaagttttgcgattttataggttacggggaagaggttatatagttttgaagtttaggaaatttaggagataataaataagatattattttagatgtatttgtaattttggagtttttttatagcgtatgtatatgataagggaaagggtaggaaaggattttaatatttgtgattaaaatttggggtgagagggagtgggggtggggtggggtgggtgagaggagataattttaaagggaggtttttttgagatagtttttttttatttgaggataggcgttaattgtgggtttaaggaaggtttttatttttaaagttatttgttttgagtgggttaatgtggttttttagttttgtttgtttgtattgggggtacggagggtaggttttgtgttgatgtttaattagaggtagtttttatttttttaagatggtagagagaggagggttatatagatttggttaagtagatggaggagagtaagagttagaaaaggggagttagtgatggaggtaggatataggatatagatatatatatatatatatatatatagcgggtttaacgtttattttttggtaaatttgaaagatagatttttaaaaaaataaataaaaaaaagataaaataaaaaaagaaataaaaaaaaaattaataagacggtatgtggataagtaggtgggggaggtggttttataggtttaagggttattttattttcggaagagtcgtttagcgagattagagttttaggtttttagatttgtttatattttttgtaggttttatatttgtattttggggttcggatggggtagtggttttggtttttttagtagagtggagtgaaacgtagaggaagggtaggcgagtttgtttttttaaagtttttgttgttttttgagttgttattttaaggtagggagaggaatggtaggatggggatgcggagtattttaggaggttagttagttggttggatgtattttaagttgtatttttgtggtggttgggggtttaggtgtgagaaatttcgtgaagagatttttattttgggtttaatataggaaatttttggtatatcggagttaggttagggaagaggttattgtaggttttcgttagtgattttatttataggttttattttaaaattttcgggtagaagggtatggttgcgtttgtagttagaaatagaattaattagtgggagaggtagttaaaggggtaagagattaggataaaattttttttgttggttttagtttggtttatgttttatgattttgtagttgcgttattaaatataagtttttatgggaatttaggagagaagggggggtttttattttagtatttgagtttatatttttttagagaggaggcggtatcggttatttgtttggggttagagaatgaggggtgtttgtgaggagttggggagaggtttaagaggggtgggtttgggtatataaggtgttgataaagatttaattttttgtgttttttgaagttttttttaattttaggatttaatatcggtatagagtgttttaaattttaatttttaatttttaatttatttcgagtaaagtaggaaggtttggtttgagtttttttgttatttaaagttttttgtttatttgcgtataaatttggaggtgaatttgttgaagatgtttttagaggtttttcgtcggttttggttgtggttagagggagaggttggggttatatcgtagggtaaattttgttggtttcgtatttgtcggagttgtttagtatggaaggtgtttcggttggatatatttcgggggaagttagttcggtttggggttttattattgttgttgatgttgtgggcggatggggaggtaatagggatacgttggggggttgtgttgtgggaagagaagtggggttgagggggacgaattagggtataggatagttattattgggtatttggatattttgtggtggggatagggagggggatgttagggtagaggtagttattacgaggatatagaaggaagggtgtgattattgaggatagtggtgagaaggaagtttcgtggaagtggaaggagatggtttgggaagggagggagggaggtaaggaaggatttttgtgtggagtgtggtttaggttggagatagcgggttttttgggagtcgggtagattggatttttaaggcggtaatggggattaatttttgaggattgagtttttgtgatgtcgattattttcggggtttttaaggaaattttggaaggtttagaataaaaaggtttttttttggagttttaggatagttttttgtatatttgttttgagagggagaattggaaaagaggggtattaatgtttttttttgttttttttattttttggtcgtaggggatagatttattttttgtggttaagatgataagaatatagtaggatttttaagtgggaagaagaaattgttggggtaagggggtagggtgggttgagggtagtaggtgtattagttgttttagtatatttgtttgggtcgcggtattttatagttatttttcgtggggggtagtttagaggttttgttggggtgtacggaggtcgatatggatttttggtgttggcggggtcgggtcgtagagattgcggtagaagtagaagtcgtggaggttcgggattttggtatggttaggttaggaaataaaagtagcggagaggttcgtgttaggggtgagtgagggcgggaggtttggattaggaagtaagggtaggggaagggttagagttggggagttttggtagggtagaagttaggtttgggtagtagcgggatgtaagttagaattgaggaatgcggggttgagaagtggaggtgagtgaggtcgggaagtagcgaggtgggttagtgtttgggaagaggaattagaaatgaaggagagtagataaggggtcgttgtttttaggttgtattggttttttaagaattttaagaataggagagttttttttatagaaagagtggggtgttgttgaggggaaatttttataaatttagaagagatagagttaggaatgtaatattaagaaatgcggtcggtgaaggttggggagttttggttttatggggatggttggagtcgttttttatgtgtatattttttaaggtgggtattttttggttttgttttgagttgggatttttaatataaggttttagttgtttatgtttagaggagggtagttgttatgttttggtcgtggttaagaagcgagtatgtagttgagatggttacggttagttttatatttggtaaattgtaagtagtagttagaggaagatggggaggaggtaatggcgtggaataggggaggggaaagttggattggatatagttaggatggaattttagggagtagggagtaatgcgttggtagggataggagacggtgttgttgatagatattattttgtgagatatggtttttagggagtgaggtaggtagggttcgggttttttatttgtttttgttattttggatggaggtttggtcgaggttggttcgttttaaaagtggggaatttttgtttcgatttgtgttggtggagaggacgttgttttgtggggaataaagggtaagcgttttattagaaagttaaagtggtttatagttaggttttttttttaggtttatggaataggttttttgttttttttatttgaagtagatagtggtaggttaaggaaaggattttgtatttattgttgggagcgaggttttttgttataagtagaagtagtagttaaagggaatagagtttgaattaagagaagagttgtttggagagggtaggttttatcgtaggaaggaaggagagagcggggggtgcggtttatcgtggagggggttggggtggttttttttttttttagatcgggtagggggttggtaggtattttggttgtgttgttggtttttcgttttgattttcggttttttttaggtcgtttattttttgcgttgttattttgagtttttttagagtaagaattagagg

SEQ ID NO: 310 - DNA, 6435 bp, Artificial Sequence
  chemically treated genomic DNA (Homo sapiens)
atttttttttttatttttttatagtttttgaatttgtgggatagattgtggtagtaatggtaaatcgatttgtaattagttttaggtgtatatatatatatatatagtttgttatatttttttagttatagttattcgttttttttagtttttgttgtagttttttacgtttgttttcgtatatataattgtatttttttgtatttttggtttcggttattggtttggttttttagttattttttttcgtataattaagttcgtatttatatagttttatagttttagttgatattatagttttaagtaaatagttttgtatattatttattttttaaacgttgagtcgtttatagtgaggtttgttatttatataatttttgttataatttttgataatttttattgtagttttatgtttacgtagttttttatatgtggttttggttatttagtttgttttgttcgttattaaatagtgatagggttgtagttttcgtttttttttcgtagatattattttgtgtatattattataggtttttgtatagtattttgattatttatttaggtttagttattttttgaaatatagttataattttttatatagatatattattaaaagtttgtggttataatttttgtatatttttatatataattatagttttttacgtttttgatatatatatggttatcgatatgtagtttttattattgttttttatatacgttattatatcgttttttttataatcgatttttgttttatattttttatatatagttatgcgtgttacgtttagttagttttgataatattagagaaaaagtgttagtagtttttagtattattttgaaaaatatatatttataggaataattttttattttttgggattttttagaaaaaaaaaaggtttattttggggaagtaaaataaatagtggagacgagtgtagtattgttttttaaattattaatttttaggttttaaggtttgggttgggttagcgttaataggtgagtttaggagttttttgaatttatttttttttgtttagaatagagataggataggttttatgttttttattttttttttttaattttagggatattgaaagggttttttgtattcgttcgtaggaaattggggggttgggagggagggaattgaaaatttatgtttggtattaaaaataaatatttggagtgggggaggcggtaggaagatttttttttaaatttttttttttttatttattttattaaatataggaagagatgatttttttttttttattgaaaagttttatttaaaaatagattatattattaaaatggtagcgggggagagatagggagatttggagtattggttggaggggttttttagacggggattattttttaaaaaaattttttattgggaggaaataggtaggattttagggaggttggtagataaaggaatggttttttagggggaagaataaaagggatatttttttttggttaaaaagttggttgaaaaggataagttgtttgagagaaaggttggggaggtggaaatttttattttaagggtgtgatttttttttggttaagatttttaatttattaaatggtataaattttttttggatttttgagtatggttaggaataataaaataaaataaattaatttttttatttatatttaaaaacgtagatagggtttttttatttttttaagggtaggttgagaaataaagaaagaaaggtcgtttttaagttagatttcgattgttttgttttggggaaaaaagtggggaggtgggggagatgttttaattattttaaaaggttaggttaggttttttttagtggtttttaaaaaataaataaataaatcgtttttattattgaagtaggagacgtgtaagggcggttattgggggattgatagaaaatagagaagttgtggaagttgtgtgttttttgtggaggagataatgagagttatttttgggagtaattttttttaaggatttttattttattataattagagtatgagttttttagttgaattatgtttttttttgagatggttggttggagagagtatggatggagtgattttagaaggggtggtggtggtggtggtagtagttatggtttttggggttttggggagagtattacgggggtcgagaggttatttacgttgatagaagggatgtgtatttgggcgttgttattggatggaaattgggggtaaaaagagggagaggttatagatgggggttatttttgggttttttattttgtttaaaacggggaaagaggattttatttggaaggagagtttggtcgggttacggggcgtaatgggatttagggtgttttagaagtgaatgttaggaggtagcgagttgggtgttagtagtatcggggtttgtggggagagggtggtcggagtttaagtgagtagaaagtagatgtgggatgttggaagggatttggtttcggttttattatagattttttatttatatttttagggttattttttaaagtgtatatatttagatggtaattatggaggttatgtttatgattttttaaattttgtagatattttttattttttattttcgagagtttatttttagttgttgagattttattggttaagattatttataagattttatttaaatgttgtttttaaattttttaagttattattttaatagtttagggttaatttttaatttatgttttatttatgaaattttatatgtatattttagattaaaaagttttgtttaggttttttaagttatattttaatttagaaatagttttatagaaagattttcggttttatttataaaagtttttagttttgttttttattaattaaattttatttttttagttagtattagtttagttaattatatttaaaggttttattttttttaggaataattatatttatttttttttgatttttgttagttattcgttatatgttaattttattggtgttggcgtttatatattttattttttcgtaggtatttattaatgtatgcgtaggaagtagggatggggttagcgtcggtttcggagtttggaggtcggagttatttttcgattttggggttcgttcgggtttcggtttatttagtaggttcgggttgagtggaagttttaggtttcggggttttcggtttttttgcggttgggagattttagggttggaagtcgtatggtcgttcgtttgttttgcggtgtttataataatcgcgggtagtcgggttggtacgtttttttgtggagggatttttggttcggttttggtggtttttggtataaattttttttttttcgtaatttttaatttttttttgggtttttttatttttatttttgggggtaaagttcggtttaaattcggttttatattaagttttttcgattttaggtttggggtttcgggcggggttaggatgatttggtagaggagtaggtataaagagggtgtgtaaggattgttgggattataggatttttttgtgggttatttagtgattttttcgggaaggtggtatttggtatttagggtatgattgtatattagagtaagttttttaataggatataggatttcgttaaggaagtagggttttttttggggtaggtttttttatgggataggggatttggggtgagataatttgaagcgggtaggaatttgagggatattatttttatttattaaaatagtggtttttaaaaatttatttttttttggattagtaatatttgttttatttggtaataagttaaaaatgtaaattattgggtttttttttagttttataaatttagaaattttgggggtgtgtttggtaatttgtggtttaataagatttataggtgattttgatgagtattagagtgcgagaattagtgtattaaatatattttaggtatttatatgttcggtagttattaattgtagtatagtatttttttttttttgttttaggatttgtgtagttttttgttttatttttttttttaagaggatgttttttttttattattattttttttaacgggatagttatgttttttttattagtttttttcgttattcggggattatatattttttttttttattgtttttttttattgaatttttatattttagtttttatttgtagaggtaagtcggtttttttagtttttagataggtttttaaggggtttggattggtgtttttgtttttcgaggggggcgttgttgtttttgtaggagttgtattggggagtattatagtaggtcgaggatgagggggtggttgcggttgtagagattggatggtgaaggtggaatagaggttcgagcgtatgtattcgtttcggttgttgcgtgttaaatcgtttgggtttgttatttttgtatttttgggtgtgtttggttttttagagatagtgttttttggggcggtatgtatagtagtaggggttatatttggtatggtggaggtaatagatatttttggttggggcgggtagtttttagtggagtattttgcgattttagggtaggatataaatttgtagacgaatttttggtcgtttattttgcggatgatgttttaggaagggaggagaggaatagagggttttagaggaaaggggtaggttggaggtagggtgttaggggggaggaggggggtggagtggtatttttttttttttagtggttttttttttatttgttttttttcggttttttcgttttttttttgtaagttttttttttagtttatttttttttttattggtttttattttttttttttttcgttagattttttttatttatatttttttttagtttttttttttttttttttttttttataataattttttttttaagtttttttttatttatttttttttaagtttttttttgttattttttaggttcgtttatttgatttttttattttttttatattgtagtttttttttataatggggtttatgaagggtagtaggtgtgggagtaggttttttttttggttttaagaattagaggtttatagggttaggttttgtgggtgattgttaggatatagttttggagattagtaaatgtaataagataagaaaatgaagtaattgatataaatgttggaagaaagtaaattaatgtagatggatggggtgatgaattattaatatagaggattatttgaagttaatgatatagaagtggaatagggtaaggttattgtagaggagagggtgaggaggttttattattaatattattgtggaggttgaagttaaaatggtaagaaaatgaagtaattaatagtaattagataagaatattaaaaatattggtataaatattgggagggggtttatattaaggttggttttgttgggttatagagtatgtttggggttttttaggtttggtgggttttagagatgatttagtgtttttagagggtagagtgagatagttttattattaatattgttttggagggttgagtttaaggaataaaatatgaaaatggaataaatgttataaattatgaagggtgtgtagtatatgattagggtagttttgggagtgtggaggtattagggtattttgtggaagttttagtgttggttagatatgttatagggtgggtttgtgtttttcggaagaggaataaaaagggatatttatgaatattgtttgggaaattttagtagaaggattaagaaaatgaaataattggtataaatattggggggaggagaaatttagtagtggtttgggggtttgagagggtaggatgggggaaattttaaattttagttgtaggaataagataatgaaaataattgatataaatattggggtagattagtgtttttttgggaatttaagaagatagtgtgtggaagttggtattaaatatgttgttttagaggttttagtttaaggaataagagaagaaaataattagttaaaaatgttgggagttttagaggacgaagtaagtaaaagttggtataatattgttagggaggttttgattttaggaatatgaaatattttggaataagagaagattatgaaataattagggaagtttagtattggtttaggggttttagaggatagaatgaggattagttattattaatcgtgtttttaagatgttggttataggaatacggtaggaaaatgaaacgttgtgtatggtagggtagtattattttggggattttagagtgggagtagaaagagttagtattaataatgtagtggtggttttcgttaaagtagtaagataagaaagtaggtgagatagtgtttaggggtttaatattggttttagggtat

SEQ ID NO: 311 - DNA, 6435 bp, Artificial Sequence
  chemically treated genomic DNA (Homo sapiens)
gtattttaagattagtattgggtttttaaatattattttatttatttttttgttttattgttttggcgaaaattattattgtattattaatattgattttttttatttttattttgagatttttaaagtgatgttgttttgttatgtataacgttttatttttttgtcgtatttttatagttaatattttgaaaatacggttaataatggttggtttttattttgttttttgaaatttttggattagtgttgggtttttttagttattttatagtttttttttattttagaatattttatatttttagaattaaaatttttttgatagtattatattaatttttgtttatttcgttttttgggatttttaatatttttaattaattattttttttttttattttttaagttaaaatttttgaaataatatgtttaatgttaatttttatatattgtttttttaaatttttagaggagtattggtttattttaatatttatattaattgtttttattattttatttttatagttaaaatttaaaattttttttattttgtttttttagatttttaggttattgttgggttttttttttttttaatatttatattagttattttatttttttaatttttttattgaaattttttaaataatatttatgaatatttttttttatttttttttcgagaaatataggtttattttgtgatatatttgattagtattaagatttttatagaatgttttagtgtttttatatttttagaattgttttggttatatgttgtatattttttatagtttatggtatttattttatttttatattttattttttgagtttaattttttagaataatattagtaatgaggttattttattttgttttttgggaatattaggttatttttgagatttattagatttgaaaaattttaaatatgttttgtgatttagtaaagttagttttgatataggtttttttttaatatttatattagtatttttaatatttttgtttaattgttgttagttattttatttttttattattttagttttaatttttatagtggtattaataatgaggtttttttatttttttttttgtagtgattttgttttgttttatttttgtattattagttttaaataattttttgtattaataatttattattttatttatttatattaatttatttttttttaatatttatattagttattttatttttttgttttattgtatttgttagtttttaaaattgtgttttgatagttatttataaggtttggttttgtgaatttttggtttttggagttaggaagaagatttgtttttatatttattgttttttatgggttttattgtgaagaggagttatagtgtggagggagtgggaaaattagatagacggatttggagagtgataaagggaggtttggaaaggggtggatgggaaggggtttaaagaaaaaattattgtggagagaagagagaaaggggaggaattggggagggatatagataaggggaatttggcgggagaggaaagaggtagaaattaatgggagaggaaatgggttgagagagaaatttatagaggagggacgggaaagtcggagaggagtaagtgggaagaaagttattaggagaagagaaatgttattttatttttttttttttttttgatattttgtttttagtttgttttttttttttaaggttttttgttttttttttttttttttagaatattattcgtaaggtgagcggttagaagttcgtttataagtttgtgttttattttgaggtcgtagggtgttttattgaggattgttcgttttagttagaggtgtttgttatttttattatgttaaatgtggtttttgttgttatatatgtcgttttaggggatattgtttttggaaagttaggtatatttaagggtgtaggaatggtaggtttaggcggtttggtacgtagtagtcggaacgagtatatgcgttcgggtttttattttatttttattatttagtttttgtagtcgtagttatttttttattttcggtttgttgtggtgttttttagtgtagtttttgtaggggtagtagcgtttttttcggggagtaggagtattagtttaagttttttggaggtttgtttggaggttgaagaggtcggtttgtttttgtaggtaaggattggaatatagaaatttagtaagaggaggtagtaaagaggagggatgtgtaattttcggatgacgagggaggttggtagaagagatatagttgtttcgttaaaggagataatggtggaaggaagatatttttttagaaggaggggtggggtagagagttatataaattttgagatagaaaggggagaatattgtgttatagttagtagttgtcgaatatgtaggtgtttggaatatgtttaatgtattggttttcgtattttagtgtttattagaattatttgtaggttttgttaaattatagattgttaggtatatttttagagtttttgaatttgtggggttggggaggggtttaataatttgtatttttaatttgttattaaatgaggtagatattgttggtttagaggaaggtaaatttttgagaattattgttttaatgaatgaggatggtattttttagatttttattcgttttaggttgttttattttaagttttttgttttataggaggatttgttttagaggaagttttatttttttgacgaagttttatgttttgttggaggatttgttttgatgtgtagttatgttttgagtattaagtgttattttttcggggaaattattgggtggtttataggagaattttgtggttttaataatttttatatattttttttgtgtttgtttttttattaggttattttgatttcgttcgaggttttaaatttgaaatcggaagagtttaatgtggagtcgggtttgggtcgggttttgtttttagaagtgaaagtagaagggtttaaggaagagttggaagttgcgggggagagagggtttgtgttagaaattattaaggtcgagttagaagtttttttataggagggcgtgttagttcggttgttcgcggttgttatggatatcgtagggtaggcgggcggttatgcggtttttagttttgagattttttagtcgtagaagggtcggaagtttcgggatttagagtttttatttagttcgagtttgttaggtgggtcgggattcgaacggattttaggatcgggaagtggtttcggtttttaggtttcggggtcggcgttgattttatttttgttttttacgtatatattggtgagtgtttgcggaggggtggggtgtgtgggcgttagtattaatgggattggtatgtggcgggtgattgataggaattagaggagggtgagtgtggttgtttttgaagagggtggagtttttgagtgtgattgattgggttgatgttggttggagggatggggtttgattagtgaagggtagggttggggatttttgtgggtgggatcgagggtttttttgtgggattgtttttaggttggggtgtggtttaaggaatttgagtagggttttttggtttgggatgtgtatatggggttttatgggtgggatatgagttggaagttgattttgagttgttgggatggtgatttgagaggtttgagagtagtatttggatagggttttgtgggtggttttgattaatgaggttttagtaattgagggtgggttttcgggagtggggagtggggggtgtttgtagagtttgagagattataggtatggtttttatggttattatttaggtgtgtgtattttggggagtgattttgggagtgtgagtgggaaatttgtggtggggtcgggattaagttttttttagtattttatatttattttttatttatttgagtttcgattattttttttttatagatttcggtgttgttgatatttagttcgttgttttttagtatttatttttggagtattttgagttttattgcgtttcgtagttcggttaagttttttttttaggtaggatttttttttttcgttttggatagggtgagagatttaagaatggtttttatttgtgatttttttttttttttgtttttagtttttatttagtggtagcgtttaggtgtatattttttttattagcgtggatggtttttcgattttcgtggtgttttttttagggttttagaagttatgattattattattattattattattttttttggggttattttatttatgttttttttagttagttattttaaggagaaatatagtttaattgaaagatttatgttttgattgtggtggggtggggatttttgggaagaattatttttaagagtaatttttattattttttttatagaaaatatatagtttttataatttttttgttttttgttagttttttagtggtcgtttttatacgttttttattttaatggtaggggcggtttatttatttattttttgaaggttattgggaggagtttgatttaattttttagggtggttaggatattttttttatttttttatttttttttttaagataagataatcgaggtttggtttgagaacgatttttttttttttattttttagtttgtttttggggagatgagggagttttgtttgcgtttttggatgtgagtagaagagttagtttgttttgttttattatttttggttatatttaggggtttaggaagaatttgtattatttaatgggttgggagttttggttaaggaagaattatatttttggaatagaaatttttatttttttaattttttttttagatagtttattttttttaattaattttttggttagggaggaatgttttttttgtttttttttttgagaagttatttttttgtttgttaatttttttggggttttgtttgtttttttttaatggagggtttttttggggggtggttttcgtttggggggtttttttagttagtattttaggtttttttgtttttttttcgttgttattttgatagtataatttatttttaaatggggttttttaataggggagagggagttatttttttttatatttggtggggtgggtgggaaggaagggatttgggggggaatttttttgtcgttttttttattttaagtgtttatttttgatattaaatatgaatttttagtttttttttttttagttttttaattttttgcgggcgggtataaaggatttttttaatgtttttggagttgggagggaggaatgggggatataaagtttgttttgtttttattttaggtaagagagagtgggtttaaaagatttttgggtttatttgttagcgttggtttagtttaggttttgggatttgggggttggtgatttgggggatagtgttatattcgtttttattgtttgttttatttttttaaaatggattttttttttttttaaagagttttagagaatggggaattgtttttgtaaatatatattttttaaagtgatgttggaggttgttggtattttttttttgatgttgttaggattagttgagcgtgatacgtatgattgtgtgtggagggtgtgaggtagaggtcgattgtgagagaaacggtgtgatggcgtgtgtgagaaataatagtagggattgtatatcggtaattatgtgtgtgttagagacgtggaaagttgtgattgtgtgtgagagtgtgtagaagttgtgattatagatttttgatggtgtgtttatgtgggaaattgtggttgtgttttagaaaataattgagtttggatgaatagttaaggtattgtataagaatttgtgatggtatgtataaaataatgtttacgagaagggaacggggattgtagttttgttattgtttgatggcgagtaagatagattgggtgattaaaattatatgtgagagattacgtgggtatgaaattatagtagaggttgttagggattgtggtaaagattgtgtaggtgataaattttattgtaggcgatttaacgtttgagaaatagatgatgtgtaaaattgtttatttgaggttgtagtgttagttaaagttgtaagattgtatgggtgcgaatttgattgtacgggagagaatggttgggagattaaattagtgatcgagattaaagatataagaaggtgtaattgtgtgtacgaaagtaggcgtgagagattgtagtaaagattgagaaaaacgaatggttgtgattgggagagtgtgataggttgtgtgtgtgtgtgtgtatatttgaaattagttgtaaatcgatttattattattattatagtttattttataggtttagggattgtgagaaagtaggagagaaaat

SEQ ID NO: 312 - DNA, 4406 bp, Artificial Sequence
  chemically treated genomic DNA (Homo sapiens)
ttagtttggattttttacgtttggggaaaaaggttgtatttggagttcgaggtatttattatttgtttattttaggtaagggtcgtttatatttaggggttgaggatattttcgatgtagttattttagtttacgggagttggaggttttggttttggttttttagatatggtatcgtagggtttcgtgttttgtaagtttttaataaatgttggttttatgggtattttaagatagaagagagatcggaatttattttttttatatttatgtaggttattttttttagttgttttttgtttttagggtagcggttattattttatagtttggtttgtggtgttgttgtggacggttgtggtatttgtttttatgtttattatcggttggggttttattttaggttatatagttattgtatagtagggcgggttgtttaggtggtagagttcgggatttttaagtttttttacggttaagggttttatatttattagttttacgtagatgacgaagggtggtcgggcggttcggaagtgtaggatggggattcggggtttgggttttttttgagagtgatagtggttattagttttgttcgagtttggagtttgttttcggagagacgtttttagggtgtacgtagttattaagttggtttatataggagttagggtttgggtagtagataacgtgttagggttatagattgcggtaggtgtttagagtaggaattcggttttcgttattttcgtttgatattcgattgtagaattgattagggtgggttattttaaggtttagatttacgagggatagcggggttttttttttaagaatgggggttgggttttttggaggtttcgaggagttagtacggtttaggtggattttgttaagggggaaggttcggagtagttgttttttagtttcggagtaggtggttgattttaagggtgatattatgcggttttgtatatttgagagttttcgtggtaatagaagttttttttgattttgttttcgtttacgttatagaatgttattatttggggataagtatagaagggtagttttggataggtcggggttagggtttgtgttgtgggatagtacgggggtagggtaggtagtgttggagggtggtaggatgtttattttgcgttggttgtcggtagttaagttgcggtatagtcggcgtttttgtttgttagcgttttagatggtgaaggtcgtttagcggggtagggtttgtttttttaggaagcggacgcggtgggtttagatggtcgttttgcggtggagaagagggtgataggtaggtcggaggttttatagatgtatatagatgttgatatatagggatatgatgtgtgtttagtttacgttgttagtggagtggatatttggtttaatgtttaagagagattggttgttttatagttaggttatttgttttagttggacgtagttatatgtttaggtggggatttattttttttattagattttaataggtggggatagatgagaagttgttatttaagaatttagaaggttttggaaggtagaatttttgtaggacgtagaggattggatttgatttaagtttagttttttagagaaatttttgtttataaggatatatgtaattattttataaaattttagcgtttatatttggatacgattttttgttttagggtcgttgtttcgaatttttttatttttttgggaatttggtttttgttttttttttgttgtgataagtcgattttaggttgttgtttcggggggagtaggtttttttttatgatttgttgttttgtttagcgtttagttttatcgttgttcgggttttttttagtttcgttttttttttttttatcgtagtttttttttacgtgttttatcgttgtttgtttgtgtgtgttttttttttaattttgtttttggagttgttcgggttgagttcgttttaaagttttaggagttggacgggttagaagttagaggggtaggggatgtagaggttaacggggttagaacggcgtgggatgtgttttagatgttgttttttttaatggtcgcgatgtagttacgttgaagttcggtattttatagattttgttttggtcgagttttgggatgttttttgttgtgttaagggagttgtgttcgtgggagtttttttcggggtggggtttgggttagatataattaatattggttggtgacgggttttttttgagtagggttttcgtgggtttagtttcgggatcggggtaggatttcgttgttttacgattttgttgttgttttcgtttttcgggataaatttgtgatttttttttaattttgtggtattttttgtttgtagtagaatttttataggtaatgggatgggggggatggggggatacggggttttttttgttagtttagggagttgtagggtttaggtattgttagggaggttttgtttggagtttatttttttttttttaattttttgtagttattttaatagttcggattttatttgggatatagggagatgtttattttagttagtgatttggggatattgaagtatgtgtgtgtgtgtgtatattgtgtgggggtgtatggtgtgtgtgtgtgtatattgggggtgtatggtgtgtgtgtgtgtgtatattgggggtgtatggtgtgtgtgtgtatattgtgtgggggtgtatggtgtgtgtgtgtgtatattgtgtgggggtgtatgtgtgtgtgtgtatattgtgggggtgtatggtgtgtgtgtgtgtatattgtgtgggggtgtatggtgtgtgtgtatattgtgggggtgtatggtgtgtgtgtgtgtatattgggggtgtatggtgtgtatgtgtgggggtgtatggtgtgtgtgtatattgtgtgggggtgtatgttgtgtgtgtatagtgtgtatgtgtggtgagtgtatgtgtatatgagtacgtgtatagtgtgtgtaggtgttcggagtatatgtttgtatgtattgtgtggatgtgtgtatacgtatgtgtatacgtgtgtgtagtgagggtttgtgtatgtagtatgagtatatgtatgtagtgagtgtatatgtttgtatgtatcgtgtagatgtgtgtatatgtagtgtgtgtgtacgtgagtgcgtgtgtgtagtgagcgtgtgtagtgagtacgtgtgtatattttcgtgtacgtatgtgtgtgtatgttgtatatgtggtttgtgtgtacgtgtagtgtgtgtgtgtgtgtgagaatttgggtgaggatagtttttgtagacggttgcggggatttttttattaggtgacgtagtttcgtcgggttttggtattttgtttttagtagttcgggtgtgttgggtgtttcggggcggggggacgagtttgattttttttatttattgatattagtttagggattttagggggtttacgtgataggaaagtagttagggttttagaagaaagcggggggtttttgtggtcgtgggtggtacgcgaggtttggggggtttttgatatcggttttttcgacggttttttgttttttgggtttttttaggggtttttggtttgaaaatgttggtttatcgtaggaaggtaaaatgtagaagtagttatgatgtttgtatttggtttatttttattttttatattttaaaaagtttttatttaattagggagaataggttttttagggcgttttatgtttttttttttatatttttagaggaagtcgtggtttcgttttagtatcgggaaaggtggaaatttagttttttttaaaagtataagatagtatttttggaaatgttgtaaaggagttgaagtgttagggatacgttatcgtatgaggaggcggttaaggtgtcggtgggtataagggagaggagcgcggacgcgggaggttttagtatgtaggagtgaggatgatgtttttaatggggaagttcgtggtttttttgttaattttttagttttatttcgtgattttggattttagattttttggggagttgggattttgtcgagagttttaattttattacggtaggtttgggattatcgcggtttttatatttatatatgattttagttggggttttgagatttcgggggttttgagtattcgtaggggtcgagacgtaagtttcggacggcggtttgttttttaatttaacgttgcggtacgcggtaggtaggtggtcgagatttttgtgtttttatagttttaaggagggaattgtttgttcggatttaaggaaggaattttatatgtagttttatttcgatttgttttatttttgttacggttttaacgtagttacgcggtatttttagattcgggtttacgtggtcgttttttatagtgatacg

SEQ ID NO: 313 - DNA, 4406 bp, Artificial Sequence
  chemically treated genomic DNA (Homo sapiens)
cgtgttattgtgaggagcggttacgtgggttcgggtttgggggtgtcgcgtggttgcgttggagtcgtggtaggggtgaggtaaatcggggtgaaattgtatgtagaattttttttttagattcgggtagatagttttttttttagaattgtgaggatatagaggtttcggttatttgtttgtcgcgtgtcgtagcgttaagttggaaagtaggtcgtcgttcgaggtttgcgtttcggtttttacgggtatttagggttttcggagttttaagattttaattagggttatgtgtgggtgtgggagtcgcgatggttttaggtttgtcgtgatggggttgagattttcggtaagattttagttttttagggggtttaaggtttaaggttacggggtggggttggggggttggtaggagggttacgagtttttttattgggggtattatttttatttttgtatgttggggtttttcgcgttcgcgttttttttttttatgtttatcggtattttggtcgtttttttatgcggtgacgtgtttttgatattttagtttttttgtaatatttttagaaatgttgttttgtgtttttgggaaaaattgggtttttatttttttcggtgttaaggcggggttacggttttttttgaggatgtaaaaagagaggtatagggcgttttggggagtttgttttttttgattaaatgagaattttttaaaatgtgaaaaatgaagatgaattaaatatagatattatggttgtttttatattttatttttttacgatgggttaatatttttagattagagatttttaggaaagtttaggagataaggggtcgtcgaggaggtcggtgttagaggttttttaaatttcgcgtgttatttacggttatagaggtttttcgtttttttttggagttttgattgtttttttgttacgtgaattttttggggtttttaagttgatgttagtggatgaggaggattaggttcgttttttcgtttcgagatatttaatatattcgggttgttaaggataagatgttaaaattcggcgaggttgcgttatttggtggggaagttttcgtagtcgtttgtaggagttgtttttatttaggtttttatatatatatatatattgtacgtgtatatagattatatgtatagtatgtatatatatacgtgtacgaaagtatatatacgtatttattgtatacgtttattgtatatacgtatttacgtgtatatatattgtatgtatatatatttgtacggtatatgtaggtatgtgtatttattgtatatatgtatttatattgtatgtataggtttttattgtatatacgtgtatatatgcgtgtatatatatttatatagtatatataggtatgtatttcgaatatttgtatatattgtatacgtgtttatgtatatatgtatttattatatatgtatattgtgtatatataatatatatttttatatagtgtatatatatattatatatttttatatatatatattatatatttttagtgtatatatatatatattatatatttttatagtatatatatatattatatatttttatatagtatatatatatatatattatatatttttatagtgtatatatatatatatatatttttatatagtatatatatatatatattatatatttttatatagtatatatatatatattatatatttttagtgtatatatatatatatattatatatttttagtgtatatatatatatattatatatttttatatagtatatatatatatatatatgttttagtgtttttaagttattgattgggataagtatttttttgtgttttaggtggggttcggattattgaggtggttgtagagggttggggaggaaaaggtagattttaggtaggatttttttgatagtgtttaagttttgtagttttttgagttgatagaggggatttcgtgtttttttattttttttattttattgtttgtgggggttttgttataaatagggggtgttatagggttgggggggagttataagtttatttcgggaggcggaggtagtagtagaatcgtagaatagcgaaattttgtttcgatttcgaggttgaatttacgagggttttgtttaggggaggttcgttattagttagtgttggttgtgtttggtttagattttatttcggaggagatttttacggatatagtttttttgatatagtagagggtattttaggattcggttagggtagggtttgtggggtatcgggttttagcgtggttatatcgcggttattggggaggatagtatttgggatatattttacgtcgttttggtttcgttggtttttgtattttttgtttttttagtttttggttcgtttagtttttggggttttgagacgggtttagttcgggtagttttaggagtagggttgagggagaggtatatataggtagatagcgatggggtacgtggggaggggttgcggtgggaggagagagggcggggttgggaagggttcgggtagcgatggggttgggcgttgggtagagtagtaggttatgggaaggagtttgtttttttcgggatagtagtttggggtcgatttgttatagtagagggagaatagagattaggtttttaggggagtggaagggttcggggtagcgattttgaggtagaaggtcgtgtttaagtgtgaacgttgggattttatgggatggttgtatgtgtttttatggataaaggtttttttgggaaattggatttgggttaagtttagttttttgcgttttatagaaattttgttttttagaattttttagatttttaagtgatagttttttatttgtttttatttgttggggtttaatggaaggggtggatttttatttaggtatgtggttacgtttagttggggtaggtggtttgattgtaggatagttagttttttttaggtattgggttaggtgtttattttattggtaacgtgagttgagtatatattatgtttttgtatgttagtatttgtgtgtatttgtggggttttcggtttgtttattatttttttttttatcgtaggacgattatttggatttatcgcgttcgttttttggaagagtaggttttgtttcgttgggcggtttttattatttggaacgttggtaagtaggggcgtcggttgtatcgtagtttgattgtcggtagttagcgtaaggtgagtattttgttattttttaatattgtttgttttgttttcgtattgttttatagtataggttttggtttcggtttgtttagagttgtttttttgtgtttgtttttaggtggtggtattttgtgacgtggacgagaataagattaggaaaggtttttattgttacgaggatttttaggtgtgtagggtcgtatggtgttatttttggggttaattatttgtttcggggttgagggatagttgtttcgagtttttttttttggtagagtttatttgggtcgtgttggtttttcggggtttttagggagtttagtttttatttttggggggagaatttcgttgtttttcgtgggtttaggttttggggtagtttattttggttagttttgtagtcgggtgttaggcgggggtggcgggagtcgggtttttgttttgaatatttgtcgtagtttgtgattttggtacgttatttgttgtttaagttttggtttttgtgtgagttaatttggtggttgcgtgtattttgagggcgttttttcggggataagttttaggttcgggtaggattgatggttattgttatttttaggaaagatttaagtttcgaatttttattttgtattttcgagtcgttcggttatttttcgttatttgcgtgaagttggtgagtgtggggtttttggtcgtggaagggtttggggatttcgggttttgttatttggataattcgttttgttgtgtaatgattgtgtggtttgggatgagattttagtcgatggtgggtatggggataggtgttatagtcgtttataatagtattatagattaggttgtggggtggtggtcgttgttttgggggtaggaggtagttggagagggtggtttgtatgggtgtgggggggatggatttcggttttttttttgttttaaaatatttataaagttaatatttgttagaaatttgtaaagtacgaggttttgcggtgttatgtttgaggggttaaggttaggatttttagttttcgtggattgaggtggttgtatcggggatgtttttagtttttgagtgtgaacgatttttgtttggggtgggtaggtgatgggtgtttcgggttttaaatgtagtttttttttttaagcgtggggagtttaggttgg

SEQ ID NO: 314 - DNA, 4417 bp, Artificial Sequence
  chemically treated genomic DNA (Homo sapiens)
gaaatttcgtttttattaaaaatacgaaaagttattcgggtttggtggcgggcgtttgtaggagaatgtagtgaatttgggagcgggaggttgtagtgagtagagatcgcgttattgtattttagtttgtacgatagagcgagattttattttaaaaaaaaaaaaaaaagaaagaaagaaagaaaaagaaaagagggtggagatgggggatgatatttagtttaggaggtgtttatggtttggtttttcgtggggagaaggaaggttatacgattggtgtggtttagggggtagggttttagtattttaagtcgagtttttttttttattttttgaggttggtattggtagtttaggtgggggtttggggatttgaatgggatgaatgggttaagggggatgttattttttttatttttttttatttattgttttttttttttttttttttttttttttttattttcggtttatttattttttattttagttaggagtcgttatttaagtagaaaaggggtttttggaaagggggcggggttttgatttttgggtattttgcgtttgaagaggaattttgggaaggggttgtttagggatttggttttttttttatttggttgtataatttttttgtttttttttttttttagtcggttgtttttttttgttttgagatgttaggaaagagggggttatttgcgttttttatagtggttttcgaagtttggggtttttagttttagagtttagaggtgaaggaggtgttatagttttggtgattattggttgttttttagttttttttatgttatttttttttaaaataataaaataaataaataaaattgggtttggcgtagtggtttatgtttgtaattttagtattttgggaagtcgagacgggcggattataaagttaggagattaagattattttggttaatatggggaaatttcgtttttattaaaaaatataataaattagttaggcgttttggtgggcgtttgtagttttagttatttgggaggtcgaggtaggagaatggtaggaattcgggaggcggattttgtagtgagtcgagatcgcgttattgtagtttagttttaataatagagcgagatttcgttttaaaaaaaaaaaaaaaattgattggaatattttttaagatgtaagatttttagttttttagagttttataggaaggatggtagagtgtagttgtttagagttgaagttttatttttgttatttgttggttgtgtgattaggtataaattattaatttttttgagtttgtattttattatttgttgttattgagtaatagtagtggattattttttatttttatttttattttatttattttatttttttttgagacggagtttcgttttgttatttaggttggagtgtagtggcgtgatttcggtttattgtatttatgtttttcgggtttaagcgatttttttgttttagttttttgagtagttggaattataggcgcgtattattatatttagttaatttttttttttttttttagtagagatagggttttattatgttggttaggttggtttcgaagttttgaatttaggtgatgtatttgtttcggttttttaaagtgttgggattgtaggtatgagttattgcgtttggacgaacgtttttaattatattattattattattattattattattattattaatttttgagatggagttttgtttttgttgtttaggttgaagtgtaatggcgggattttggtttattgtaattttcgttttttaggattaagagatttttttgtttaagttttttaagtatttgggagtataggtatgtattattacgttcgacgatattttgtaattttagtagagatggggtttttttatgttggttatgttggtttggaattttttattttagttgatttatttatcgtagttttcgataattataggcgtgagttattacgtttagtcgtttattttgttttttattagagttttgtattgtgattttgtataaaatagtttggaagttggatttattttgtgtgtgtgattgttttgagtttatagaaagatatttttagagtgcggattgagaagtttttattgtgggaggatcggggtgttttagggtttcgggagacgggatggatttggaaggttggggggaggggtttttgaggaagaggagttttggaagcgggggttattataggttaaggggtggtttttgggattttcgtagttagtggtgttgcggcggtagagtgtatattgatagttgagagttacggcgtaggagattacggggtttacgtcgcgcgggtagttagggagtcggatggattcgaagcgtatatcgcggtagttgtatattatttgaggtagggtcggtaggattttttgtagtacgcgggtttggaagtcgtgtgagtgggggaatgagtatgtgtttggggttagcgttttagttgagttttttagttgtttttataggttttagatttaggggtttaggaagttttttgtttttgtttttttatattttatttcgtagtttttgattagagaggtagattattttttttttttcgttgtttttgtgggtttggttttgaggtggtagtatttgttttggtttcgggtagtttattatggtggggtagtagtcggtatagatggtggtgttgacggtgatgtatacggggtagttttttttttttatagttagggtggtattgatggggcggtatcgtggtcgaagcggttttttggatgtttatgtttcgtttatgtttagtagtagtaatagtagtagtttttggggtaaggatattgttttattcgggtttgagattgtagtttttagttttggtttttttatttcgtatggtatattatttataaagatttagagatttttttcggtattttttatttaggatttattattcggatatttgttttttagagtttattttatagtttagaggatttgagatattttaatattttagattcgtatttttaggaattgatttatttgaagtttattgggggttacgtttttttagaaagaggtttttttttatagtttatacgggtttgtttttttttatgttagtgatggtttggaaggaggtggaaggtgtttaggggttttgtagttttttttggaatatttttatttttggtgttcggaaatgtggatttattttatttttgatatgttttttttttagcgggatatttttcgtaagtattgggaatgtggatatggaaagtaaattgagttttcgtgggggagtgagatagggagtgaggggtgttggacgcggtacgggaatttggttagagttagcggatttaattggttgtttttttttagatgtagtttttttttttttttttagggggcgttacggaacgtagggtttttattggttttggggattgggtgacgttagggatgagttttttgtgattggttttattattttgcgtaagattaaagggaagaaaggatgggttcgataatcggagttattgtggtttcggtcgattgagtttgttttcgggtttttaaggttaggcgagggtgtgagggattggagttcgaggttaatttgggttttattggtaggaaaaaaaaaaaaaatttttttatcgttttttatataataataaaatataaagggaggacgttttgataggaagaaatgatatttttttaagtgtttttaaattattttaatgtatttttttttttttttttgggatatcgagttttgttcggttttcgggggatttttttgtttgttagttatggcggtcgttatttgtggtaaatagaatggcgggagtaagtgggatgttttattattcgggttgaggtaggagaattataggaatttaggaggtggaattttttcgtttaggaggggcgcggtttcggatttagtttttgtttaatgagagagggttttttcgtgattgtgttgttaggttagttatttgattttggtgtcgttaacgagggatttagttcgagttttattttttttttagggatttttgtttattttatttttaagttaggatgttcggagcggttttcggaaatgcgtgtgtttcgggtgatttaattgattattgaataggttcgtaggaggtgtgttttgttttcgaggtcgtagtttcggaggatattatttggatttagtttttttttcgcgatgttattaagttggataattttaaggtttgttttttttttaatgtagggtataggatggtatagggaagagggttagaaatttgatttgagtttttcgtttagggttgaattttttagtattttgattattttttattgaattttgtttatat

SEQ ID NO: 315 - DNA, 4417 bp, Artificial Sequence
  chemically treated genomic DNA (Homo sapiens)
gtataagtaaggtttaatgagaagtgattaggatgttggagagtttagttttgggcggggagtttaagttaggtttttagtttttttttttgtgttattttatattttatattgggaaagaaatagattttaaaattgtttagtttgatggtatcgcggggaagggattaagtttagataatgtttttcgaggttgcggtttcgggggtaggatatattttttgcgggtttatttaataattagttaaattattcgaagtatacgtattttcggggatcgtttcgggtattttggtttgagggtagagtgggtagaggtttttaagggagaggtggggttcgggttgaatttttcgttggcggtattagggttaagtggttaatttggtagtatagttacggggaggtttttttttattgggtagaaattaagttcgaagtcgcgttttttttgggcgaggaggttttattttttaggtttttgtgatttttttgttttagttcgagtagtgggatattttatttgttttcgttattttgtttattataggtgacgatcgttatggttgataggtagggaggtttttcgaggatcgagtaaggttcggtattttaaaaaaaaaaaaaaagatatattgaagtaatttaaaaatatttaggaagatgttatttttttttattaaggcgttttttttttatgttttgttgttatatagggaacgataaaaaaatttttttttttttttttattaatggggtttaggttgatttcgaattttagttttttatattttcgtttagttttgagagttcgagggtaggtttaatcggtcggagttataatggtttcggttgtcgggtttatttttttttttttttgattttacgtagggtgatggagttaattataagaggtttatttttgacgttatttagtttttagggttagtgagggttttgcgtttcgtggcgttttttggagggaggaaggggaattgtatttgagagagagtagttaattgggttcgttgattttggttaggttttcgtgtcgcgtttaatattttttattttttgttttatttttttacggagatttaatttattttttatgtttatatttttagtgtttgcggaagatatttcgttaagagagagatatgttaaaggtagggtagatttatattttcgggtattaaagatggagatgttttaggaaagattgtagggtttttgggtattttttatttttttttaggttattattggtatgagaaggggtagattcgtgtgagttgtggaaggaggtttttttttggaggagcgtgatttttagtaagttttaggtgggttagtttttgagggtgcggatttgaaatgttggggtattttaggttttttgggttgtggggtgggttttgaaaggtaggtgttcgggtggtgggttttgaatagaagatgtcgggaagggtttttgggtttttgtgggtggtgtattatgcgggatgggaaggttaggattgggggttgtagttttagattcgggtgaagtagtgtttttgttttagaggttgttgttgttgttgttgttgagtatgggcgggatatgggtatttaaggagtcgtttcggttacggtgtcgttttattaatgttattttggttgtggagaaggagggttgtttcgtgtgtattatcgttaatattattatttgtgtcggttattgttttattatggtgagttgttcggggttagggtaggtgttgttattttagggttagatttatagaggtagcgggggaggaagggtggtttgtttttttggttaggggttgcggaatggggtgtgggagggtaggaatagagggttttttggatttttgagtttgagatttgtgggggtagttggggagtttagttgaggcgttggttttaggtatatgtttatttttttatttatacggtttttagattcgcgtgttgtagggggttttgtcggttttgttttaggtggtgtgtaattatcgcgatgtgcgtttcgagtttattcggttttttggttgttcgcgcggcgtgaatttcgtggttttttacgtcgtggtttttagttgttaatgtgtattttgtcgtcgtagtattattgattgcgggggttttaaggattattttttgatttgtgatgattttcgtttttaggattttttttttttaaaggtttttttttttagttttttaagtttatttcgtttttcggggttttaggatatttcgatttttttataataaaggttttttaattcgtattttggaggtgtttttttgtgggtttagggtaattatatatatagggtgggtttagtttttaaattattttatatagagttatagtatagaattttggtagaaaatagggtggacggttgggcgtggtggtttacgtttgtaattgtcggaggttgcggtgggtggattagttgaggtgaggggttttagattaatatgattaatatggagaaattttatttttattaaaattataaaatatcgtcgggcgtggtggtgtatgtttatatttttaggtatttgggaggtttaggtaggagaattttttgattttaggaggcggaggttgtagtgagttaagatttcgttattgtattttagtttgggtaataaaaataaagttttattttaaaaattagtaataataataataataataataataataatataattaaaaacgttcgtttaggcgtagtggtttatgtttgtaattttagtattttgggaggtcgaggtaggtgtattatttgagtttaggatttcgagattagtttggttaatatggtgaaattttgtttttattaaaaaaaaaaaaaaaaattagttgggtgtggtggtgcgcgtttgtagttttagttatttaggaagttgaggtaggagaatcgtttgaattcgggaagtataggtgtagtgagtcgagattacgttattgtattttagtttgggtgatagggcgagatttcgttttaaaaaaaaataaaataaataaaataaaaataaaaatagaaaatagtttattattattatttaatagtaatagatggtaaaatataggtttagagaaattaatgatttgtgtttggttatatagttaataaatggtagagatgggattttaattttgggtaattgtattttgttattttttttgtagaattttgaggaattgagagttttgtattttggaggatgttttaattaattttttttttttttttgagacggagtttcgttttgttgttgagattggattgtagtggcgcgatttcggtttattgtaagattcgtttttcgggtttttgttatttttttgtttcggttttttaagtagttgggattataggcgtttattaggacgtttggttaatttgttgtattttttagtagagacggagtttttttatgttagttaggatagttttgattttttgattttgtgattcgttcgtttcggttttttaaagtgttgggattataggtatgaattattgcgttaggtttaattttgtttgtttgttttgttgttttgggaaagggtggtatggagaagattgggaaataattagtggttattagagttgtagtattttttttatttttgagttttggggttgggaattttaggtttcggaggttattgtggaggacgtaggtggtttttttttttttgatattttaggatagggaggggtaatcggttaggggaagaaaagaataggaaggttatatagttaggtggggaaggggttaaatttttgaataatttttttttagagtttttttttaagcgtagggtatttaagagttaaggtttcgttttttttttagaggttttttttttatttaggtgacggtttttggttgggatgggaggtagatggatcgggggtgggaggggggggaggaggggaagggagaggtagtggatgaaggagaatggaagagatgatattttttttggtttatttattttatttaggtttttaagtttttatttggattgttagtgttaattttagagggtggaagagggagttcggtttagaatgttgaggttttgttttttgggttatattaatcgtgtggttttttttttttttacggaaggttagattatggatattttttgagttggatgttattttttatttttattttttttttttttttttttttttttttttttttttttttttttgagatggagtttcgttttgtcgtgtaggttggagtgtagtggcgcgatttttgtttattgtaatttttcgtttttaggtttattgtatttttttgtaagcgttcgttattaagttcggataatttttcgtatttttagtagagacggggtttt

SEQ ID NO: 316 - DNA, 4420 bp, Artificial Sequence
  chemically treated genomic DNA (Homo sapiens)
tttttggtagttttgggggtttttttttgtatttcgaaggaaggggaggcgtgtggttggaggtgagaggttttgaggttttgtttggtttttagttttttaaattcgtttttttttgggtcgtcgtttttagagattgttgaggatacgagttttttatttacgggttgttttaacggagtcgggttaggggtttttggatagaggtcgtttgtttttttgggttttggggtttgttttttttagtagtttattcgggtttttggggttagggtatcgggtagaagttagaggacggtgcgtttgggatttgagttttgggtagttttcggggtttaggatttttggtttttttgtttagttttatgtgttttgtgttttgaaattacgtgtggttttatagttgtgtttttagaagtcgtcgtggttgtcgtgaggtagtagtggacgggacgtttacggttttttttatgttatgttgtttttagtcgggttttattatttttttataagttgaaaggaagtggtttttttattagttttggttgggagttttgtgggcgaggttttttttaggagttgtttttttaagtgttttaggtattaataagattttacgcgtgttttttttatagtcggtttcgtttaggcgtcgttgttttagtagaggtgggtggggggtagtgtggagttgtattgcgaggtcgtgggtagttcggtgttcgagatttagtggtggtttgaagggtagggttttaacgatatttgtttttagttttgggacggcgttcggttggatcgcgtttatatttacgttatttattattagtacgcggttagtattatttttatcgatacgttcgtggaggaggatacgggtatttacgagtgtcgggttagtaacgattcggatcgtaattatttgattcgggcgtttagggttaagtgggttcgcgtttaggtagtcgtgttagttttggaacgtgagtggcgggtattttttttttcgttttttttagttttttttttgtgtcgttcgtttttcggtttttgtttagtagaatttagacgttttttttttttttcgtttcgttgtgtttcgttgggtttatcgtttggacggaggggttcggatttgaagggggtgggttcgtcgtttgattattagcgttgggcggtttggttcggggtaggtagggttttgttttttagtaggtgggttttcgtttttttttcgattttcgtgttattcgtttcgtcgtttttgttttttcgggcgtttgttcggttttttttttgagcgtttatattgtaagtttgaggggttttttaagtttagtttaggtttgtaggttttagaattttttgtgtttttcgtagtatttcgttttaagggatttttaaattttaatttttagcgggaatattgtaaattaattaagaattaagagatttgtttggttggggattggtagaagaatcggggtgtttttagtattgttggagtgtcgttagtttggggttggggggatgtggggttatttgagtgttttttagagaagggtacgggagttttggtcgggggtgttgtggttatttttttttttttttttggagatggagttttgttgtttttaggtggagtgtggtggtataatttcggtttattgtaattttcgtttttcgggtttaagcgatttttttgttttagttttttgagtagttgggattataggtatgagttaatatgtttagttaattttttgtatttttagaagagacggggttttatcgtgttagttaggatggtttcgatttttcgatttcgagatttattcgttttggttttttaaagtgttgggattataggcgtgagttttcgcgttcggttattatcgcgtttagttggttacgtttttagaaaagaatttttagtttgtgttggggttgttataagagttcgatgttttggtttttgtttagggacgtgggtgggtgttttgtttgtttttatattttggttttagtttcgtgtgtttttgggtaggaatatcgttaggcggggtttttgggtttttagcgttttagtttagggttcgttagttgttagcgaagggtgttttttcgaagggggtgttttttcgaaggggtttttttagtaggcgttgggttttttttttttcggaggcgtggttagaagttttttttgggttttcggttttcggggcgtaagggttacggtgtatttttgggatgaaaattagtttttttcggggaggagtcgtaggtttttgggggttaggtaggtagcgcgggtcgtgtttttttattttgttgatcgcgtttcgtcgggttttgtagtcggtatagtttttattatcgtagaagattttggttttaagatattttttatttgttttttgaatgatagcgttatagaggttatagggtatcgttggttgaaggggggcgtggtgttgaaggaggacgcgttgttcggttagaaaacggagtttaagtgagtgtttgattacgttatgtcgttatttgtttttttttacggtttttttgtcgttagcggtttgtggttcgtgagaataaaagatcggtcggtaggtttgatttaggcggaagttagggattagtttcgcgtagatttttagagggaaattttagggaggggtttgaggggcgtttttgtgaggtagggggttttagtagttttggtaggagtttttattgtttgttttttattaggtttcgggtacgaaagggcgttatattgttaggtttcgggtacgtgtgcgggttttttaggttttgtgtttttggtataagagggtattatattgaggtatgttttgttcggattttagacgttgttatggtcggagttttgttataattggggttgggacggttttgggagtatagagttttttgtttttaggttgattgggaagacggttatagggtgtggggtgtagagtagggattagaggtgtggggtttattagtcggggagaagggggtttgttggtttttttatttgtggggttttgttagtttggttttgtttttggggtcgtacggggattttaggagtttttttgaggtttagatttgattgggatagttttgtttttttattgtgtcgtggttgggtttttggagaattttgggtttttggaggcgttttgtagagttggtacgcggtttatttgtttgttgtggttgtagggtggatttcgacgattagtggggagagtatttttgcgttttttttttcgagtttatgggtacggttaatatttagttttacggtgagttttgtagttaggggtatcgggtattatcgattgtcgggagaagttgttggtttgaggtattcggtatattttagagttttggttttttgttttttggaggggaatagtttttttgcgggaggtcggggatgggggcgggtttgcggttttaggttttttttttttatttttttgttagggttttttagagtgaaggttgtgaagtcgttagaatatattaacgagggggagacggttatgttggtttgtaagttagagttcgtgttatttgttattgattgggtttggtataagattattgattttgaggataaggtgagaagttaaggaggttgggggttttggatttagtttttaggattgggtgagaggtttagattgggggtttcggatttagtttttaggattgggtgaggggtttagattgggggtttcggatttagtttttaggattgggtgaggggtttagattgggggtttcggatttagtttttcggattgggtgaggggtttagattgggggtttcggatttagtttttcggattgggtgaggggtttagattgggggtttcggatttagttttttggattgtagttttttagattgggtgaggggtttagattgggggtttcggatttagtttttaggattgggtgaggggtttagattgggggtttcggatttagtttttcggattgggtgaggggtttagattgggggtttcggatttagtttttcggattgggtgaggggtttagattgggggtttcggatttagtttttaggattgggtgaggggtttagattgggggttttggatttagtttttgtttttggttttttaggtttttatgaacggtttcgagagtaggtttttcgtgagtttttcgtagggtcggttagagttatatattgagaatttgaatatggaggtcgatttcggttagtatcggtgtaacggtattagttttaagggtttcgattaggttattattacgtttcgcgtgcgtagttatttggtcgttttttggttttttttgggtatcgtggttgaggtgttggtgttggttattattatttttatttacg

SEQ ID NO: 317 - DNA, 4420 bp, Artificial Sequence
  chemically treated genomic DNA (Homo sapiens)
cgtagatgaagatgatggtgattagtattagtattttagttacgatgtttaggaagggttagagggcggttaggtggttgcgtacgcggagcgtgatgatggtttggtcggagtttttggagttggtgtcgttgtatcggtattggtcggggtcggtttttatgtttaggtttttaatgtgtagttttgatcggttttgcgaggaatttacgaagaatttgttttcggagtcgtttatgagggtttaggggattaaaggtaagggttgagtttaggatttttagtttaggttttttatttagttttgagggttgagttcgggatttttagtttaggttttttatttagttcggagggttgagttcgggatttttagtttaggttttttatttagttcggagggttgggttcgggatttttagtttaggttttttatttagttttgagggttgggttcgggatttttagtttaggttttttatttagtttggagggttgtagtttagagggttgggttcgggatttttagtttaggttttttatttagttcggagggttgggttcgggatttttagtttaggttttttatttagttcggagggttgggttcgggatttttagtttaggttttttatttagttttgagggttgggttcgggatttttagtttaggttttttatttagttttgagggttgggttcgggatttttagtttaggttttttatttagttttgagggttgggtttaggatttttagtttttttggttttttattttgtttttagagttagtgattttgtattaggtttagttagtgataggtggtacggattttgatttgtagattagtatggtcgtttttttttcgttgatgtgttttgacgattttatagtttttattttgggaggttttgataggagggtgagagagaggagtttggaatcgtaggttcgtttttattttcggtttttcgtaggagggttgtttttttttagggagtagggggttagggttttgggatgtgtcgggtgttttaggttaataatttttttcgatagtcggtggtgttcggtatttttggttgtaggatttatcgtggagttggatgttggtcgtgtttatgggttcggggaggaagacgtaggagtattttttttattggtcgtcggagtttattttgtaattatagtaggtaggtgagtcgcgtattagttttgtaggacgtttttaaggatttagggttttttaggggtttaattacggtatagtgaaaaagtaaaattgttttagttaagtttgaattttaaaagaatttttggggttttcgtgcggttttaaggatagagttaggttggtaagattttataggtgagagaattaatagattttttttttttcgattgatgaattttatatttttggtttttgttttgtattttatattttgtgatcgtttttttagttagtttgaaaataaaaggttttgtgtttttagggtcgttttagttttagttatgataaagtttcggttatgatagcgtttggggttcgagtagggtatgttttagtgtggtgtttttttgtgttaggagtatagagtttgggaggttcgtatacgtgttcgggatttggtagtgtggcgttttttcgtgttcgggatttagtgaggagtaagtaatggggatttttgttagggttgttggagttttttgttttataaggacgttttttagatttttttttggggtttttttttgggggtttgcgcggagttggtttttaattttcgtttggattaagtttgtcgatcggttttttgtttttacggattataggtcgttggcggtaagagagtcgtgagaaggggtaggtggcggtatggcgtggttaggtatttatttgaatttcgttttttggtcgggtagcgcgtttttttttagtattacgtttttttttagttagcggtgttttgtgatttttgtggcgttgttatttaaggagtaggtgaggagtattttggagttaaggttttttacggtagtgaagattgtgtcggttgtaaggttcggcgagacgcggttagtagagtggaggagtacggttcgcgttgtttgtttgatttttaggaatttgcggttttttttcgggaaggattggtttttattttaaaaatatatcgtggtttttacgtttcgaggatcggaggtttaaggggaatttttggttacgttttcgggaagggaagagtttagcgtttgttgaggaggttttttcgggaaggtatttttttcgggaaggtatttttcgttggtagttggcgggttttgggttaaggcgttgggaatttagaggtttcgtttggcgatgtttttgtttagagatatacgaggttgggattagggtgtggggatagataaggtatttatttacgtttttgagtagggattagggtatcgagtttttgtagtagttttagtataaattggaaatttttttttaaaaacgtagttagttgggcgcggtggtggtcgggcgcggaggtttacgtttgtaattttagtattttgggaggttaaggcgggtggatttcgaggtcgggagatcgagattattttggttaatacggtgaaatttcgttttttttaaaaatataaaaaattagttgggtatgttggtttatgtttgtaattttagttatttaggaggttgaggtagaagaatcgtttgaattcgggaggcggaagttgtagtgagtcgagattgtgttattatattttatttgggaatagtaagattttatttttaggaaaaaaaaaaaaaatagttatagtattttcggttaaggttttcgtgtttttttttaggaggtatttaggtggttttatatttttttagttttaggttgacggtattttagtagtgttgggagtatttcggtttttttgttaatttttaattaagtaaattttttggtttttggttagtttataatattttcgttaggaattgaaatttgaaaattttttagaacgagatgttgcgaaggatatagaaggttttgagatttgtaagtttgggttgagtttggagggttttttaggtttgtagtatggacgtttagggagggagtcgggtaggcgttcggggaagtagaaacgacggaacggatggtacgagggtcgaggggaggacgaggatttatttgttggagggtagagttttgtttgtttcgagttaggtcgtttagcgttggtggttaggcggcgagtttattttttttaggttcgggttttttcgtttaggcggtgggtttaacggggtatagcgggacggagaggggaggaggcgtttgggttttattgagtaggagtcgggaggcgagcggtataggagggaaattgagggaggcggggagggaggtgttcgttatttacgttttaggattagtacgattgtttgggcgcggatttatttgattttgggcgttcgggttaggtggttgcgattcgggtcgttgttggttcggtattcgtaagtgttcgtgtttttttttacgagcgtgtcgatggagatggtgttggtcgcgtgttggtggtaggtggcgtggatgtggacgcggtttagtcgggcgtcgttttagagttgggagtaggtgtcgttgggattttgttttttaaattattattggatttcgggtatcgggttgtttacggtttcgtagtgtagttttatattgttttttatttatttttgttgggatagcggcgtttggacgaagtcggttgtggggagagtacgcgtggggttttgttagtgtttggggtatttgggagggtagtttttggggaaggtttcgtttataggatttttagttagggttggtggagaagttatttttttttagtttgtgggagagtgatggggttcggttggaaatagtatggtatgggaaagatcgtgggcgtttcgtttattgttattttacggtagttacggcggtttttgagggtataattgtgggattatacgtggttttaaaatataaaatatatgaaattgggtagaagagttaggagttttgagtttcgagggttgtttagagtttaggttttaagcgtatcgttttttgatttttgttcgatattttgattttagagattcgggtgagttgttgagaaaaataaattttaaagtttaaaggggtaggcggtttttgtttagaagtttttagttcggtttcgttaggatagttcgtgggtggaaagttcgtgtttttagtaatttttgagggcggcgatttagagagaggcggatttgggaagttgggagttaggtagggttttagggttttttatttttagttatacgtttttttttttttcgaaatgtaagggaaggtttttagagttgttaagga

SEQ ID NO: 318 - DNA, 4258 bp, Artificial Sequence
  chemically treated genomic DNA (Homo sapiens)
tttttaaagtgttgggattataggtttgagttattgcgtttggtttaaagtaattgtttttttattggtttttttgtttttggttttattaaacgttttattttaaattattgtagataaggggttttgtttaaggaggagagtttattagttaaaattttttagtagtttttaattattttaggataaatgtagatttatttttcgttttttgttgtcgttttttttttttttagattttatatggttttagttatatttttagattatttgggttgttgtttgttttgttatatattttttttatttcgtttttttgtaagttttatttaggttgtatttatatagttgttttagtttttatttgaggttttcgtagttttttttgaaagtttttattatagttaatgatattgaaattgtttttttatgtagggtacggaaagatttatttaatttattgtttaatttttttttttggtgtagaaaagatatttagttagcgatttgtattatttgtaggtatgagtgaataataataatgtttaatttttatatagtgttaattttacgtttggtattgttttaggtatttatataaatttatgtaatttatataattttaaaattgatgatatttttttattttattaagtattgagtagttaaataatttgttttagatattaaggggtcgagttggggtttgaagtttggttatttataaatgaattaagaattggaaggaggataagagtttcgagaaggagttaggtagggcgtgatttgtgcgttttatatttaagattttttagtttttagggagttcgttttatagagtaggagatagaggttgggagggatacggagagtttcgagagtcgtgtggaggaagcggtgttgtttggggttcgggagtaagggcgtggtttggatgcgcgggcgttcgggacggtacgtttttagattaaattataatttttaggatttagcgggcgttgtcgtttacgcgacgttacggcggcggagggcgtaggcggttgggcgtttggcgagtggattgttcgagttttttcgttgggattcgggttttggtttcggtttcgcggtaagtggggcgattttagtttatttagttcgcggaggtttcgcggcgtacgttcgtagtttttattatagcgcgggcgcgtagacggggttggtatttattatatggggggtattcgggtcgaattaagtgattcgcgtggggggtttcgttggggatttcgtgtcgtatttttttaagtcggttttaggggtttagggttggtgtcgtacgttcgttggtcgcgtttttagggttcgggtttgaaggcgttgggtaggtaggggtagtttcgttttttgagaagggtattcgggatttcggggcgttggggcgaggttttcgggttggaagggtttgaggggtttttttttcgatagtttttttatcgttagtagagtttcgggttggggaatagaagttttcgggaggttaggttttttgggcgcggtttgtgtgtatttggggagacggtgggagtggtggggagaggtcgttcgggtttggggagatcgatgtataggtggagagatggtgcgggttttgtggattcggatttttataattttttttttttcgtttcggtagatgggagttgtttttcgcgggttgagtttgttagtattttcgacgtattttggtttttgaagtcggagaagagtttttatttatttatatttttttgttttattttgggtcgtttgggtttttagttttagcggatttttagttttagcggttatcgggtttgaaaggagtaagacgatgattttggcgtcggtgttgaggagcggtttcgggggcgggttttcgtttcggttttttttgggattcgtattcgcgtttcgggttcgttcgacgtcggttatcgatatatattacgtggagatggttcgggagcgttttaagatcgttatttttttttataattagtcggttatcgacgcggtagcggagaaggtgcgtaagggggtagttagtttagggttcgggatgtaggcgggagggagagtgttgggggttttttgtttaaggtttttttttttttttagtttttagttcgtttaacgtttattatgatgttttacgttggtcgtttttaggacggtagttattttttggtaagatttacgttttttatttttttcgtggattttggagtttttttagatatttaggttttagtttcgttttttttttttatttttttttagaaaagtgttcggtatttgtagtaagaatttttagtgaggattgtttatcgtattaagggttttcgttgttttttttttattattggttgtaattttattatattgtacgtggtaaggtagagaggattttaggttagcgggttattttgtttcgggggtaagtggggagtttggggtttagagtggtagacgattgtttgtttaaaggtgttagggttatataggatttaattttaggtttttagaagttaaaggtgtgtatttacggagtttggaagggtcgaagtgggggtttgattacgtggtcgattagttgggtggtgatttttatgggtaggtgggggtggttgttttttgtttagtgtttatgcggttttgtgaatttttatattttttttttgtagtatgagttatatattcgtgttttttagaagttgatagattttttttcggtgagtgttgggttagagtagggtgaggggttgagaggttgggtttggattatttttttttatgattttgtgatttgtagattaaggattaggcggacgaggtttagtattgttagttggtgcgatagttgttggatgattataaggatgtggtgatttttttggtagagggtttacgtgagagtcggaagtatatagaggttggggtagtaaaggagaggtcgggtttgttgggggtgggaagggtacgggattttgagattttattttttataggatgaaaagttcgttcgttattttttggataagacgttgatttcgaggtttggaattcgtatgttggttacgtattatttggcgttgtatgaggataaggtggggttttgggatttgagatttatttgggaatattaagtgagatagaggagattgggttggggattcgggttaagggtttgggggttgaggttgtggggttggtgttttggggtagtttcgaagttgttagtattttggggtggggttaggggcgtgggtagttttgatttttttttttcggttagtttgattttgtcggtattatttgtattcgttttttattaaagaagattattgagaagtgggtggattttgttaggtgaggtaagaatggtttagggggtgggtagatatttggggtagggaaggtttgggtttgagtttttgttcggggtatgatttgcggggagtagggttttttaattatggtattattgatatttttagttagataattttttgttataggggttgtttcgtgtacgttaggaagtttagtagtatttttggcgttagtagtattgtttagttgtgataaataaaaatgtttttgtatattgttatatgttatttaggggggtagaattgtttttagttgtaaattattggtggaggggtttttgattgaattttcgtttttattcgtagacgtttgtgtgagtataagtatggtaatgcgtttcgtgttcgtattaatggttatgtggttgttcggtttttttttatttttatgttattggattatattttgtcggagttgtttaagaatgttatgaggtggggtggtttgatgtgttggtttgggggcggataggaatcggggtgtttgtatttattggttttttttttttgtatagagttataatggagagttatttagatattttttataatgttttagatgtggttattattatcgttaataatgatgtcgatttgattattaggtttgttttgagtgggagttgagttgaggtggatgggatgggggtttaggtattgtttttgatttgatttaggattttgagtttttttttgttttattttgggatttggtttttgattagataaattattttttgaattttgagatggttatgagttgtttattaatggatttggggttagttgtaggtttaggtattttgtttttgttagtagttgaggagtttgaaattgagaaatag

SEQ ID NO: 319 - DNA, 4258 bp, Artificial Sequence
  chemically treated genomic DNA (Homo sapiens)
ttattttttaattttaagttttttagttgttgatagaggtaggatatttaggtttgtagttggttttagatttattaataagtagtttatggttattttaggatttagagaatagtttgtttggttagggattaagttttagaatggggtaggaaggggtttaaggttttaaattaagttagaaatagtgtttagatttttattttatttattttagtttaatttttatttagggtaaatttgatgattagatcgatattattgttggcgatggtgatgattatatttgggatattgtagggagtgtttaggtgattttttattgtggttttatgtagaggggaaagattagtaggtataagtatttcggtttttgttcgtttttaagttagtatattaagttattttattttatggtatttttgagtagtttcggtaggatgtagtttagtggtatagggatgaaggggaatcgggtagttatatggttattgatgcggatacggggcgtattgttatatttgtgtttatataggcgtttgcggataggagcgagggtttagttaggggtttttttattagtggtttgtaattggaaataattttgtttttttaagtaatatatggtaatgtgtagagatatttttgtttgttataattaggtagtattgttggcgttagggatgttgttgaattttttaacgtgtacggggtagtttttgtgataaagaattatttggttggaaatgttaatagtgttatggttgagaaattttgtttttcgtagattatgtttcgggtaagggtttagatttaagttttttttgttttagatgtttgtttattttttgagttatttttgttttatttggtaaagtttatttattttttaataattttttttggtgagagacgagtatagatgatgtcgataaagttaggttggtcggagaaaggaggttaggattatttacgtttttagttttattttaagatgttggtaatttcggaattgttttaaagtattagttttatagttttagtttttaggtttttgattcggatttttagtttagttttttttgttttatttaatgtttttaggtgggttttaggttttagagttttattttgtttttatgtagcgttaggtgatgcgtggttaatatgcggattttaagtttcgaagttagcgttttgtttaagaagtagcggacgagttttttattttgtaaagagtgaggttttagaatttcgtgttttttttatttttagtaggttcggttttttttttgttgttttaatttttatgtgttttcggtttttacgtaggttttttgttaagagggttattatatttttgtggttatttagtagttgtcgtattagttggtagtattgggtttcgttcgtttggtttttgatttgtaggttatagagttatgaggaagggtggtttaagtttaattttttagttttttattttgttttggtttagtatttatcggagggaagtttgttagtttttggaaggtacggatatatagtttatgttgtaaggaagaggtgtgggaatttataaagtcgtatgggtattgagtagagaatagttatttttatttatttatggggattattatttagttggtcgattacgtgattaaatttttatttcgatttttttaggtttcgtgaatatatatttttggtttttgaaggtttggggttgaattttgtgtggttttgatatttttaggtaagtaatcgtttgttattttgggttttagattttttatttgttttcggggtagggtggttcgttgatttaaggttttttttattttattacgtgtagtatggtggggttgtagttaatgatgaaaggaaggtagcggaagtttttgatgcggtgagtaatttttattggaagtttttgttgtaggtatcgagtatttttttgggagaaaatgagaagggaaggcggggttggagtttgagtgtttgggagagttttaggatttacgaggaaaatagagggcgtgaattttattagaaggtggttgtcgttttgagagcggttagcgtagagtattatggtgggcgttaggcggattgagggttagagagggagagaggttttgagtagagaatttttaatattttttttttcgtttatatttcggattttgggttggttgtttttttgcgtatttttttcgttgtcgcgtcgatggtcgattggttgtaaaaggaggtgacggttttggagcgttttcgagttatttttacgtggtgtgtgtcggtggtcgacgtcgagcgggttcggagcgcgagtgcgggttttaggaggggtcggagcggaagttcgttttcgggatcgttttttagtatcgacgttaggattatcgttttgttttttttagattcggtggtcgttaggattgaggattcgttaggattgaggatttaggcgatttaaaatggggtaagggggtgtgggtgggtaggggttttttttcgattttagggattagggtgcgtcgaggatgttgataggtttagttcgcggagagtagtttttatttatcggggcggggaagaggaagttgtaaggattcgaatttatagaattcgtattatttttttatttgtgtatcggtttttttagattcgggcgatttttttttattatttttatcgtttttttagatgtatataggtcgcgtttaaaggatttagtttttcgggggtttttattttttaattcgaggttttattggcggtgggagggttgtcgggggaggagttttttagatttttttagttcgaaaatttcgttttagcgtttcggggtttcgggtattttttttagggggcggggttgtttttgtttgtttagcgtttttaaattcgggttttgggagcgcggttagcgaacgtgcgatattagttttgggtttttggggtcggtttgggagggtgcggtacggagtttttagcgggattttttacgcgggttatttggttcggttcggatgttttttatatggtagatgttagtttcgtttgcgcgttcgcgttgtgatggaggttgcggacgtgcgtcgcggggttttcgcggattgagtaggttggggtcgttttatttatcgcggggtcggagttagggttcgggttttagcggaagggttcgaatagtttattcgttaggcgtttagtcgtttgcgtttttcgtcgtcgtgacgtcgcgtgggcggtagcgttcgttgggttttgggagttgtagtttggtttgaggacgtgtcgtttcgggcgttcgcgtatttaggttacgtttttgttttcggattttaaatagtatcgttttttttatacggttttcgaggtttttcgtgttttttttagtttttattttttgttttatgaaacgggttttttgggagttggaagattttagatgtaaagcgtatagattacgttttatttgattttttttcggagtttttgttttttttttagtttttggtttatttatgggtaattaggttttaaattttagttcgattttttaatatttggagtaagttatttaattgtttagtgtttggtaagatgaagagatattattagttttggggttgtgtggattatatgaatttatatgagtgtttagaatagtgttaggcgtggaattagtattatataagggttaggtattattattatttatttatgtttgtagataatgtaagtcgttgattgggtgttttttttgtattaggagaggagattgggtagtgagttgaatagattttttcgtgttttgtataagaaaatagttttagtattattggttgtgatgaggatttttagaggaggttgcgggagttttagatagaaattgagatagttgtgtaggtgtagtttgagtaggatttgtaagggagcggggtgggaagggtgtgtggtaggatagataatagtttagatggtttgaggatatggttggagttatatgggatttgggaaggagaggggcggtagtagagagcgaaggataagtttgtatttgttttagggtagttaggaattattgaagggttttaattggtgggtttttttttttagatagaattttttgtttgtagtgatttagagtggggcgtttggtgagattaaaggtagagaaattaataagaagataattattttaggttaggcgtagtggtttaggtttgtaattttagtattttgagag

SEQ ID NO: 320 - DNA, 4435 bp, Artificial Sequence
  chemically treated genomic DNA (Homo sapiens)
cgtaggcgtttagggtttataggttcggagcggttttcgtttttgtcggattatttagggtcgtttcgtcggaggggttttttcgttttcgagttttaggttacgttcggaaggttcggggttttcgcgttcggttacgttattcgttcggcggttttagggatttagcgtcggggttagcgtaggtttcgtttagcgttttcgttttttttagttggtcggttttcgggatcgcgttttcgttcgcgttttttacgttcgtattcgtatgggtagggcggttcggggttttttagtttcgagtcgcggttttttgaagcgcgttatttggacgtgcgttgttcgtagattttggacgagttgggtttgggcgttgcgcggcggaatcgattttgttttggatcgtaggtagtagttgatttcgcgttatcggtttgcgggcgagattttaggcgcgagacgggttgtgtgtgtgtgtgtgtgtgtgagagagagagagagagagagagagagagagagagagagagagagtgtgtgtgtgtgtgtgtgtgtgtgtgtgtgtgtgtgtgtgtgtcgggggaggggttcgaggattcgttttttagttgagcgttaggacggggggcggatttttaggagtcgcgcggcgttcgtagaggagaggaagcgtcggagatttttttgtttttattcggtttttttgtttcgttttttttttcggggttttagagaggggagttttaggcgtggggcgtttggtttacgtggtgcggcgtcgggcggggtaggcgggggcgcggcgagagtcgcggagttttttttatgggtgggggggcgggggcggtcgggtttcgttttcgggggatcggggcgcgtttcgttaatgggtagtcgggcgcggggcggggtcgcggggtcgtcgtttaaagaaatttgttgcgggtttcgtagcgggattcgagtttcggcggcggcggcggcggcggtaggggcgagggtcggggttatcgcgcggcgatttcgggtttcggagcgatcgtagggtagtttcgggcgtcggtttcggtgcgcgttttttgtgcgcgttttttcgcgcgcggtttcgatgttggatatgagcgaggttcgtttttagtcgttttgtagttcgttcggtatcgttagttttatgtcgtacgtggaggattcggattcggacgcgtcgtcgtttttcgtcggtttcgagggtttgggtcgcgcgggggtcgcggtggggggcgttcggggcgattcggcggaggcggcggacgagcgtttttcggtttgtattcgcgacgtcgtgtcgtaggtgtttaagggttacgattggagtttggtgtttatgtcggtgcgcggcggcggcggcggcgcgtttaaagttaagtcgtatgtgaagcggtttatgaacgtatttatggtgtgggcgtaggcggcgcgtcgtaagttggtcgattagtattcgtatttgtataacgtcgagtttagtaagacgttgggtaagttgtggcggtgagtgtcggcgtttcgggggcggggttcgggattttggtcgtttttggtttcggattgcgagcgggggtttggagggcgtagagttcgcggaggtggtggttatacgtaggtttcgggttttgtatttcgggcgggtgttagggcgggttttagtggaaaaatattttttggttagtcggggttcggcgttagttatgggagtcgggattcgcggagggtagcgtttggggtgtgtattttcgtggcgggtgcgttttggagttagtttttttggcggggaatattttgcggagggttatggttggtatttcgacgtgttttttagtcgttgcgagtggttttagtttcgggaggtacgttcggtacgatagtaagttgtatgcggttttttggaggtgttttttttttagaaagggtttagtttttttagtttttggattatttatggggagggagtgcggtaggcggatgggtgggtagtaggtttgtttgcgagtatttttttcgtagttttttttttttttggatattttcggttcgaagtagggagggtaggagtggagatgacggggtgcgtcgtgtgtacgttttggcgtggtggggtcggttagttttttagaaattaggattgtagagtgaagaatttgttgtttaggataggtcgtttttatcgagtgttttttggttgggttttaaatggtttttttggtttggggttttggttttcgtattttgttttttatttggaagaagggagtttggagtttgcgtatttgtattttttgttttttgtttggatttagggcgtagttacggggcgttgtggacggtaggtttttgtttttttaagttttgtcgtataggcggttggaggtgagtttcgggaagagttttaaggagtgtgttttgtggtttagtgaggacgggcgtttgggttttgttagggtttttgggtgtttgggaatggagggatagtagtttagttgttcgtcgaaggtcggtatcgttttcgggaagtttcgtttttgtttatcgtcggttgggttttgttcgtttttttcgttttttttagaaagttttagagggagggaatagtaggttcggaatagggggaaatagaaggaggaagatgggaggcgtggggtttgtttttttttggttgtcgtaagtatattaatttttttaaataggcgtcggtcggtttttttagaggagtgtattgtttggtgttacgggaggtttcggagcgtacggtaggcgggtttttttggttagagttttttggtttcggtttttgttgtcggttttttttgtggtgtgtgtttgcgtcgagggtatagtgggcgttttggttatttttgtttttgttttgtgttgtagtttgttgagcgagagcgagaagcggtttttcgtggaggaggtagagcgttttcgcgtgtagtataagaaggattatttcgattataagtattagttacggcgtaggaagagcgttaaagtcggttatagcgatttcgattcgggcgcggagttgggattttattttggcggcggtgtcgtgtataaggttgaagtagggtttggagatgggtattattatggcgattatataggtgggttttaggtttttcgtatatttgagggtttttgtatgggaggtagttgtggggtttttggttgagaagggtgtatgatggtggaggggggtaggcgttttcgagagaatcgggtttttttcgggttttttgaaaaagtttttaaggtttcggtcgtttttgtttttggtgtacgagggatttgtttagttattttgagtgttgaggggttgatagttttgtttggtagggatttcgagaggtggtgtttttagtaagatttagtttaatgcgggtttttttttttatatcgagttgttgtttatacggtatttagtagttttagttttagggttagattgatagggtggagttttgtcggggtttcggttaggttggttgacgttcgttagttttagagtgtttggttggttcggggaggaatagggtttgtgtggttttttagcgttttgtaaattttagttttggttaggttgggtttgtcggttttttttttttattttggtttttgggaggggtttcgggtttttttatagtatagcgttttatggaattttttcggtcgaggagtgaggtttaggtttgattttgttggaatttttgggaaatgtaaagaaataaaaagtcgttgatttttttggtagttagcgcgggcgtttttttttttttagtttggtcggttttattcgttttatagaaggggtatttatttttgaagtttgtttttttgtttttagggtagatttacgggtcgtttatttcgtttattatttttaagacggagttgtagtaggcgggcgttaagtcggagttgaagttggagggacgtcggtcggtggatagcgggcgttagaatatcgattttagtaatgtggatatttcggagtttagtagcgaggttatgggtattatggacgttttcgacgtttacgagttcgattagtatttgtttttgggcggtttcgttttattcgagtcgggttaggtttatgggggcgtttatttttacgtcggggcgtttttcgtgtgggtttataagagtgtttcgtcggttttcgcgtcgtttatcgagacgggttttttacggtcgtatattaagacggagtagtcgagtttcggttattacggcgattagtttcgaggttcgttcgattacggtttttgtagcggttagtttagcgttatttcggtcgttttcgtcggttttttcgtcggtttatagggcgattatggcgatttgtaggtttttagttattatggtgtttattttggttacgtattcggttttt

SEQ ID NO: 321 - DNA, 4435 bp, Artificial Sequence
  chemically treated genomic DNA (Homo sapiens)
agaggtcgggtgcgtagttagggtaggtattatagtagttggaggtttgtaggtcgttatagtcgttttgtgagtcggcgaaggggtcggcgggggcggtcggggtggcgttggattggtcgttgtaggaatcgtagtcgggcgagtttcggggttggtcgtcgtagtggtcggggttcggttgtttcgttttgatgtgcggtcgtgggggattcgtttcggtgggcgacgcggaggtcgacggggtatttttgtgggtttatacgggggacgtttcggcgtggaagtaggcgtttttataggtttggttcggttcgggtggggcggggtcgtttaggggtaggtattggtcgaattcgtggacgtcgaaggcgtttatggtgtttatgatttcgttgttgagtttcgagatgtttatattgttgaagtcgatgttttggcgttcgttgtttatcggtcggcgtttttttagttttagtttcggtttggcgttcgtttgttgtagtttcgttttgggggtggtgggcggggtgggcggttcgtgggtttgttttggggataggagagtaggttttagggatgaatgttttttttgtggggcgggtggggtcggttaggttggaaggggagggacgttcgcgttaattgttagggggattaacggttttttgtttttttatattttttagaaattttagtaaagttagatttagattttatttttcggtcgagaaaattttatgaagcgttgtgttatgagaagattcgaggttttttttagagattaaggtggggggaagaagtcgataggtttagtttggttagagttggggtttatagggcgttgggggattatatagattttgttttttttcgggttagttaagtattttgaggttggcgggcgttagttagtttgatcgaggtttcggtaggattttattttgttagtttggttttgaagttggggttgttgagtgtcgtgtgggtagtagttcggtgtgggaagaggagttcgtattggattgagttttgttgaaaatattatttttcggggtttttgttaagtaaagttgttagttttttagtatttaaggtggttaagtaggtttttcgtgtattaaaaataggggcggtcggggttttgggagtttttttagggaattcggggaaggttcggttttttcgagggcgtttgtttttttttattattatgtattttttttagttagaaattttatagttgttttttatatagggatttttagatatgcggggggtttggagtttatttgtgtggtcgttatggtggtgtttatttttaagttttgttttagttttgtatacggtatcgtcgttagggtggggttttagtttcgcgttcgagtcggagtcgttgtggtcggttttggcgttttttttgcgtcgtggttggtatttgtagtcggggtggttttttttgtgttgtacgcgaaggcgttttgttttttttacgaagggtcgtttttcgttttcgtttagtaagttgtagtatagggtagaggtagggatggttagggcgtttattgtgttttcggcgtaggtatatattatagggggaatcggtagtagaggtcggggttaggaggttttgattagggaaattcgtttgtcgtgcgtttcggagtttttcgtggtattaggtagtatatttttttgggagaatcggtcggcgtttgtttgggaaggttggtatgtttacgatagttaaagaagaataagttttacgttttttatttttttttttttatttttttttatttcgggtttgttgttttttttttttggggttttttaagggaggcgggggaggcgggtaggatttagtcggcggtggataaaagcgaggtttttcgggaacggtgtcggttttcggcgggtagttgggttgttgtttttttatttttagatatttagaagttttggtagggtttaggcgttcgtttttattgagttataggatatattttttgggatttttttcgaggtttatttttaatcgtttgtgcggtaggatttgggggagtaggggtttgtcgtttatagcgtttcgtggttgcgttttagatttagatagaaggtaggaggtgtaaatacgtaagttttaagttttttttttttaggtgaggagtaggatacgggaattagagttttaaattaagagaattatttgaaatttaattagaggatattcggtgggggcggtttgttttgagtaataagttttttattttgtagttttaatttttggaaaattgatcggttttattacgttaaggcgtgtatacggcgtatttcgttatttttatttttgttttttttgtttcggatcgagggtgtttaggagagggagaaattgcggggagggtattcgtaggtaaatttgttgtttatttattcgtttgtcgtattttttttttatgggtggtttaggagttagaggagttgagttttttttaaggagggagtatttttagagagtcgtatgtaatttgttgtcgtgtcgggcgtgtttttcggggttggggttattcgtaacggttggagggtacgtcggggtgttagttatggtttttcgtagggtgtttttcgttaggagaattggttttagagcgtattcgttacgagggtgtatattttaggcgttgtttttcgcggatttcgatttttatagttggcgtcggatttcggttggttagaggatgtttttttattgggattcgttttgatattcgttcggggtgtagagttcggagtttgcgtgtggttattattttcgcgagttttgcgttttttaggttttcgttcgtagttcgagattaggggcggttaaggtttcgaatttcgttttcggggcgtcggtatttatcgttatagtttgtttagcgttttgttgagttcggcgttgtgtaggtgcgggtattggtcggttagtttgcggcgcgtcgtttgcgtttatattatgaatgcgtttatgggtcgttttatatgcggtttggttttgagcgcgtcgtcgtcgtcgtcgcgtatcggtatgggtattagattttagtcgtagtttttgagtatttgcgatacggcgtcgcggatgtaggtcgggaagcgttcgttcgtcgttttcgtcgggtcgtttcgggcgttttttatcgcgattttcgcgcggtttaggttttcggagtcggcgggagacggcggcgcgttcgagttcgagttttttacgtgcgatatggagttggcggtgtcggacgggttgtagggcggttgggagcgggtttcgtttatgtttagtatcggggtcgcgcgcggaggggcgcgtataggagacgcgtatcggggtcggcgttcggggttgttttgcggtcgtttcgggattcgaggtcgtcgcgcggtggtttcgattttcgtttttgtcgtcgtcgtcgtcgtcgtcgaggttcgggtttcgttgcgggattcgtaataagtttttttaagcggcggtttcgcggtttcgtttcgcgttcggttatttattggcggagcgcgtttcgatttttcggaggcggagttcggtcgttttcgtttttttatttataaagaaagtttcgcggttttcgtcgcgttttcgtttgtttcgttcggcgtcgtattacgtgggttaggcgttttacgtttggagtttttttttttggagtttcgggaaaggaagcggggtagggaggtcgggtgggagtaggggggttttcggcgtttttttttttttgcgggcgtcgcgcggtttttgagagttcgtttttcgttttgacgtttagttaggaagcgggttttcgggtttttttttcgatatatatatatatatatatatatatatatatatatatatatatttttttttttttttttttttttttttttttttttttttttttttatatatatatatatatatatagttcgtttcgcgtttgaggtttcgttcgtaggtcggtggcgcggggttagttgttgtttgcggtttaggatagggtcggtttcgtcgcgtagcgtttaggtttagttcgtttagagtttgcggatagcgtacgtttaggtaacgcgttttaaggggtcgcggttcggagttgggggatttcgggtcgttttgtttatacgagtgcgagcgtggagagcgcgggcgggggcgcggtttcgggggtcggttagttggagggggcgggagcgttgggcggggtttgcgttgatttcggcgttgagtttttggggtcgtcgggcggatggcgtggtcggacgcgggggtttcgggtttttcgggcgtgatttagggttcgggggcggggaggttttttcggcggggcggttttgggtggttcggtagaggcggaggtcgtttcgagtttgtgagttttgggcgtttgcg

SEQ ID NO: 322 - DNA, 4784 bp, Artificial Sequence
  chemically treated genomic DNA (Homo sapiens)
tttggttgtattgggatttatagagttatattttggagggttttttttttgatattgataagggtgtgtattatattttagtgagcgttatacggttgggggttaacgggagttatattttttagatttttagtgtgttttttatcgaggtttattttgaagattatagtgagttgtagtcggtgaggatagtttttttagattttggtgaggtggtattatttgtttgtgttgcggatgaatttgtgattgttttgacggtgattttggatgtcgattttattaagatgattttaaagtaaaggattgattttttgtataggatgcggagttttttagaagtagagttttataatatgaaattagtgtcggtggtgaataatagattatttgatatgtcggtttttatggttggttcgggaaatgtaaaaaaggtggtggagaatggggttttttttttttggaagttgggttgttttttgaattagaatagtgtgtttgatatttatggtgtagaggtttttgttagggagggcgtaatgtttgtttagtttggttattttgtggtgggttggtatatcgttaataagaagttttttttttttaaacgcgttcggaggtagatttatgttatatttatatttgttattgttattgggtttttaattacggttatttaggagtttttatttaggatcgtgttaatttttatatttttagttattgtttttttaatagagattatggtttttttagttagggattttgtttttgggaaatttacggttattattcggattcgaggcgttattatttaaattttaattttaggttttatttagtttattcgggtgttagaagttggtattatagtttttggttagattcgtttaacgatgattatttttggttatgtggagtttattgtagttgttattttttttataattattattaagaagttacgagtatttatattaaaattagtaacgtttttaattgattttattattattacgattcgtaggttaattaagaaattacggatatttcggttagtgtttcgggttattattaaagtttttattattagattggaaattgttttatcgtttattcgtattcgtattattattagtggagtgtttcgtggcggagaatttaattagcgtttagagtttaagaattatattgatagggtagatgtttgggttggtatttattttgaggtgaagatttcgttagatattttttatgattatgaggatattattattgataagttgaagttgattttgaaattgcgggagtagtagttggtgggcgagaagttttgggtatagtttaatagtaatagttagtttatgtatggttttttcgatagtagttacgtgggtaaatacgagtattttatgtatgttatagataaggggggtttgtcggttgtggatgttttcgagatttacgtttataggcgtttttaaggggatagggtttttgtaaggtttaaggttaagtttgtgggtgattcggtattggtgttgaatgatatttataagaagattgttttggtaaagaaattggttttcgtttttggagatcgaaattgtagtattattattttgtagaatattattcggggttttatcgtggtggaatggattaataatatattgtttttggagttttgttttaaggagtagatcgttgggttgagtcgtcggatcgttgaggatgatggaaaatttcggtttgttttttttaacgttttagagtttgattttaaggttataagtattattgtgacgggttttggtagttgtcggtatttatagtttatttttgtggtattatttaggagagtgtttttagaggcgtcgtttatagaagtgtttgatagggattttgagaagagtagtgaggatgatgtttatttgtatatagttatttcggtcgtggtggtcgtagttattttgtttattgttggtattattgttatgatttgttatcgtaagaagcggaagggtaagtttatttttgaggattaggttatttttattaagaagggggtgtttattatttttgtagacgaattggacgattttaagtttttatttttttttagtatgttatttattttgtaggaggagaaggtttttttatttttttttgagtattttaattagagtgtgttcgagattatttttttgaattaggatattatgggagagtatacgtttttgcgggatgaggattttaatgcgtttttttattagtttttatcgttttttatagtatttatggagggtaagggttttcgttttaagaatatgattttatatcggttattttttttttatgttttattttaattcgtaagcgtttgggtggaggtagggtagggtaggggtttggagacgatatggtgttgtttgtggagatcggtggtttgtagattattgtttatcgggagtcgatatttgatttagtatatattgatataggggtttggataagttcgttttttttggtttttttaaattttaaagtagttggagagattttggggatttttttatttttattttttgtttaatagtttttggtttgtttatagagaatttttcgttttatttttgatggttggttttgaaagtattatgtggagtggaggtggagggagcgaggaattatgaatgaattcgtaggtagtgtcgggcggttttttggttttttgcgttttgtttttaatattaattgtattgttttttttatttacgtgtgtttagttgtaggatgtaatatggaaaatagtaattaaagattaaatttaaaggatttttagaagttaaggttaagtttttacgtttaatttgttgtttatttaaatttgtatgtataatttttgggtgggtatggggaattgttttgttaaaaataagtttttagggtgttttaaatttagagaagattaagggatagtattttttattaaaggaatattatttttttatattacgttaatttggttgttttgatattttagagtttgattgggggtttttcggttttggtttacgttaagtttttggtgttgggtttgttttttcgttgttgttaggggttggaagttggaggggttttttgggttatggatatttttatttttagtttatgtatattagtggtttacgattaaggggtttttatttttatgaaaaagggattttaagaggtagtggtggttgtggtttttaattttggtgttttagggtgggttagttgtttgtgggggtatttgggaggttaaaggtttttattatattaatttattttgttttattttttttttgtgtattgtttttttttttttttttaaaaggaatattacggttttttgaaatatttagtgggggatattttggtgaagatgtaatatttttatgttatgtgatgttttttttttatttgattttggtcgttttgttttaatagtttatagttttgtttcgatttattttattttttttttttggtattttagttttaggttttgggtttgaattattggaaaaggtttggcggttggggaggagtgttagtaatagtttataataaaaatttgttagtttttaaagttaattttttattaaagtttttatatagttttaaattgttttattaaaaaaaagatttaaaatggtgatgtttatagtagtttgtacgagtttttaagtgttgattttatggaattgacggttttgtttgttttgatttttttttttttattttttttaatggtttaaattttggaattatattggggtttttttgttttttttagtagaatattcgttcgtttatttgtatttttgttttatgatttaggggcgtttattttgtttcgattttttttttgtggaagaaattattttgagtatgattttttttgatgtttgaagcgttattttgggtattttttagggaggaatgtttttcgtaataatgtatttattttttgattgagggtgggtgggtggatttaggttttttttgtatatagagtagttatttttaagttatatcgattgttttgtagaggatttgtgtgtgttgttttaggaggggagggttggtaggagggggggagaggtttttgttttattgttttttagagggtatttttttttgcgtttttttttatagggtttagttttttttttttgttttagtttttagggggtattttggagtgagtagtgtttttgtgggggagtttgtaaatgcgggtttagtggattattggtgattgggtttatgtttttaagttagagtttttttggtgttttagagataggagtataagtgggatttgatttggtgagattatttttgatgattttattaaaaaataaataatttttaatgttttaggtgagggttttgaaaggttttttaaatagtttcgtcgtttttagtaattttattattgggtattgttatgtagagacgtggttggtttagaatggtttgttgttatagtaattggaggcgatggggtagtgaatagaataataatagtaataatgtttttgtaggtagtttgtttttttgagcgttgggttggtgatggtcgttggattttgtgagatggagagttaattttatatttaagtgtttattaattattgatgtgtttttatttttttttatatgattttaagatgtgttttttgtattttgtaaagaaatatattaaattaaataaaagtagtgtttttatt

SEQ ID NO: 323 - DNA, 4784 bp, Artificial Sequence
  chemically treated genomic DNA (Homo sapiens)
aataaagatattgtttttatttagtttgatatgtttttttatagaatgtagaaaatatattttaaaattatatagaaggaaataaaaatatattagtggttggtgaatatttgaatgtgagattggttttttattttatagagtttaacgattattattagtttagcgtttaggggagtaggttgtttgtaaaggtattgttgttgttgttattttgtttattgttttatcgtttttagttgttatggtaataggttattttgggttagttacgtttttgtatggtagtgtttaatggtggagttgttaggggcgacggagttgtttggaaggttttttaaagtttttatttggaatattgggaattgtttattttttgatgaggttattagaaataattttattaggttagattttatttgtgtttttgtttttggggtattagggaaattttgatttggaggtatgagtttagttattagtggtttattgagttcgtatttataggtttttttataggggtattgtttattttagagtattttttggggattggggtaggggagaggggttgggttttgtgggagaaggcgtaaggggaaatgttttttggagagtagtaggatagagattttttttttttttttattagttttttttttttgaggtagtatatataaattttttgtaaaatagtcgatatggtttagaagtagttgttttgtgtgtaaagggagtttgggtttatttatttatttttaattagggaatggatatattattgcgaaaggtatttttttttaaaaagtatttaaaataacgttttagatattaagaaaagttatgtttaaaatggttttttttataggaggagaatcgaagtagagtgggcgtttttgagttatgggatagagatgtagatggacggacggatgttttgttaaaaaaggtaaaagaattttagtgtaattttagaatttaaattattaggaaaagtagggggaaaagaattaaaataagtaaagtcgttagttttatggaattaatatttaagagttcgtataaattgttgtaagtattattattttaaattttttttttaataaaataatttgaggttgtataaaaattttagtaaaaaattagttttgagagttaatagatttttattatgaattattgttggtatttttttttagtcgttagattttttttagtagtttaggtttaaggtttgggattggagtgttagagaaaagggatggggtgggtcggggtaggattgtggattgttaggataaagcggttaaggttaagtgaggaaagagtattatatgatataaaaatattgtatttttattaaaatgttttttattgagtgttttaaaaaatcgtgatattttttttaggaggaaaaaaaaaaataatgtatagaaaaagggtaaaataaaataggttgatgtggtggagatttttgattttttaggtgtttttataagtagttggtttattttggagtattaaagttgggggttatagttattattgttttttggagttttttttttatggaaatgaagattttttggtcgtgggttattagtgtatatgggttggaagtggggatgtttatggtttaagagatttttttagtttttagtttttggtaatagcgggagagtaaatttagtattagggatttggcgtgagttagggtcgggaggtttttaattaggttttggggtattagagtaattaagttgacgtagtgtgaaaaaatagtatttttttgataaaaaatattgttttttggttttttttaagtttgaaatattttgggagtttatttttagtaaagtaattttttatatttatttaaaaattatatatataagtttaggtaaatagtagattaaacgtaaaaatttaattttaatttttgaaagttttttgaatttaatttttagttattgttttttatgttatattttgtagttagatatacgtgaatagaaaaaatagtatagttagtgttaaaggtaaaacgtagagagttagggggtcgttcggtattgtttgcgagtttatttatggtttttcgttttttttatttttattttatatggtgtttttagagttagttattaaaaatgaagcgaagaattttttatgaataaattaaaagttgttaggtaaaaaataaaaataaaaaagtttttaaagtttttttagttgttttggggtttgggaggattagagagggcgggtttgtttaggtttttgtgttagtgtgtgttaggttaggtgtcggttttcggtgggtaatggtttgtaggttatcggtttttatagataatattatgtcgtttttaggtttttgttttattttgtttttatttaggcgtttgcgggttaaggtgggatatagggaggaggtgatcggtatggggttatgtttttgggacgggagtttttgttttttatgggtgttgtgaagggcggtgggggttggtagggaggcgtattgggatttttatttcgtaggggcgtgtatttttttatggtgttttggtttagaggagtggtttcgggtatattttggttggggtatttaggagggggtaggggagttttttttttttgtagaatgagtggtatgttggaggagggtgggggtttggagtcgtttagttcgtttgtaaagatgataggtattttttttttgatgaaggtggtttggtttttaagggtaagtttgttttttcgttttttgcggtagtagattatggtaatgatgttagtaatgagtaggatggttgcgattattacggtcggaatgattgtgtgtaggtagatattatttttattgttttttttagggtttttgttaggtatttttgtgggcggcgtttttgagggtatttttttgggtggtattatagggataaattgtaggtgtcgataattgttagagttcgttatagtgatgtttgtggttttaaagttaggttttagggcgttggagaaggtaggtcgaggttttttattatttttagcgattcggcggtttagtttagcgatttgttttttggggtagggttttaagggtagtgtgttgttggtttattttattacgatggagtttcgggtgatattttgtagggtgatggtgttatagtttcggtttttaaaggcgaaggttagtttttttattaaggtaatttttttgtggatgttatttaatattagtgtcgggttatttataaatttggttttgaattttgtaggagttttatttttttgggggcgtttgtggacgtggatttcgaaggtatttatagtcgataggttttttttgtttgtggtatgtatgaaatattcgtgtttgtttacgtggttgttgtcgggaaggttatatatgagttggttgttgttgttgaattgtatttaggatttttcgtttattagttgttgttttcgtagttttagggttagttttagtttgttagtggtggtgtttttatggttatagaaagtgtttgacgggatttttattttaaagtaggtgttaatttaggtatttattttgttaatatggtttttgagttttgggcgttggttgggtttttcgttacggggtattttattggtggtggtgcgaatacgagtaggcggtgaggtagtttttaatttggtgatggaaattttggtggtgattcggggtattggtcggggtgttcgtggttttttggttggtttgcgagtcgtggtggtggtggagttagttgaaggcgttgttggttttggtgtggatattcgtggttttttggtggtggttgtgggaggggtagtaattgtagtaggttttatatagttaggaatggttatcgttgggcgaatttggttaggaattgtggtgttagtttttgatattcgagtaggttggatggggtttagggttggggtttgaataatggcgtttcgagttcggatggtgatcgtgggttttttaggaataggatttttgattggaggagttatggtttttgttggaggagtaatggttggagatgtgggggttggtacgattttggatgggggtttttggatagtcgtggttgggggtttaatggtagtgataggtgtgggtgtagtatggatttgttttcggacgcgtttgggaagagggggttttttattggcgatgtgttaatttattatagggtagttaagttgagtagatattgcgttttttttggtaggggtttttatattatgaatgttaggtatattgttttggtttagggagtagtttagtttttaggagagaagggttttattttttattattttttttgtatttttcgggttagttatgaaggtcgatatgttaaatagtttgttatttattatcggtattaattttatgttgtgaagttttatttttgagaagtttcgtattttgtgtaggaggttaattttttgttttggggttattttggtgaggtcggtatttaaaattatcgttaaaatagttataggtttattcgtagtataggtagatgatattattttattagggtttggggaggttgtttttatcgattgtagtttattgtggtttttagggtagatttcgatggagaatatattggaggtttgggggatgtggttttcgttggtttttagtcgtgtagcgtttattgaaatgtaatgtatatttttattagtgttaagggggaggttttttagggtgtggttttgtgagttttagtgtagttaag

SEQ ID NO: 324 - DNA, 4337 bp, Artificial Sequence
  chemically treated genomic DNA (Homo sapiens)
tagtatgaggaaatttagttgtaagaaaggagatttgggattatgtgggtgttgtgtttatttttttgatagtatttttgttgtgggagtagatgtggtagattttgaaagtcgggaggagaggaaaagaggtgttttgaggaggttgattttggttgggggtgaagaggagtttttttgtaattgtagtaaatttatggagcgatggtttttattgttatggaaataattagtagaggtttttatttttttggatttttaattataggaggaattattatatttttttgtaattttgtgtatatttaggaaaagttgaagtagtttttttaaaattatttattttttgagattattgtttagatagtttttatgttttgtttgttttttaatgttgttgggatttattaaattgattttagaatttgttaatggtttaggttgtagttggaaatttttggttttagtagagttgaattttattcgtggagatgttaggagttaggaggattaggggtgggtgtttttgggtttttattttagttttaggggttttttttttttgtcgggttacgtgtaggttgtgaaggttttatttttttagtagtatattaaattttattattttatttaagttaattttgttttttttttattcgagggtttcgcgtggatagaatattaagcggataagttcgtagggtgtttagattaagtgttgagtttgtagtgaatgtttagttatgatttgtagtggattgatttgtgtaaaaattggatttttaagttgttagttttagtgttagtacgagttcggtcgagtttatttggtcgtaggaataagggggtcgttaggagtaagagcggagggggcgtttaaagggaggagattaaggtttaattattattcgttttttaattttttaggcgtatagcggggacgtagcgtgtttttaaattaacgttattagtagagggttttagaggagtcggaaggggttagggtttgggcggcggtgggagggtttgagtagtgggggcggggagttgggggtcggttttcgttcgcgttttagcgtttcggcggtcgtcggggttattgatttcgggtttggtttttgcggtagcgtttcgagttgtcgtttttcgcgttgttagcgttcgggaaggaggaagggggaagggggcgggtcggtcgggtttacggtcgatttttttttttagtttcgtttttcgtcgtttgcgggtgagttttgtttaagtcgaggttgcggggtcggcgtcggcgggaggattgcggtgtttcgcggaggggttgagtttgttagggtttatttgattttgttttttatttttcgttttttaggttcggaggcgggggttttcggggcgattcgggggcggatcgcggggcggagttgtcgttcgtgagttcggtcgagttatttgagttcgagtcgcgggatatcgtcgtttttgtttttcgaatgttgcgtatcgcgatgggtttgaggagttggttcgtcgttttatggggcgcgttgtcgtttcggttatcgttgttgttgtttttgttgttgttgtttttgttgtagtcgtcgttttcgatttgggcgtttagttttcggattagtttgtttttgggtgagtgtcggggattcggggacgcgggtcgggggaaggaaggttgtcggggacgtgtttcgtgcggaggtggtcgtgataaaggattaaggaggggatttgtcggaggtacgggatttattaggattttttttttttttaaggcgttgcgcggagggagggagaggagaggggagttgtggggtcgttggtttttttttttagttttttttttgcgtagggatggggtttagttcgttttgtcgttttttttagtttttttaggaggatgtattttcggcggggttcgtttgtttatttatttgtttttgatgttgattagagtcgatcgcggtgtcgttttcgagggcggttcggggtagagggaggttattgtttgtagttttataaatattggggttttggtatttttagtaagtcgtagtagggtcgggagttgtggtgggcgggtaggcgttcgatttttttttttcgtttttttatttttggtttgttagtgtagttttaagttttagtatggagagatttttaggttttgggagcgattagattgcggatgggggtagttttgggcgttgatatttttaagttttgggagcgaatagattgcggatgggggtagttttgggcgttgatatttttaagttttgggcgcgatttttttttagagtgatttgggagtagtattttggttggttgggttttttttttggtttttatatttgtttttgtggttattttttgttttagtttttcgttttttttttttttttttttttttattcggttgtttttttagttttttttggggtatttgggttttagatttagagggttttggattttaagtttattttttttattgggtaagtaagtgttttttgtttttagtgttttattttttttatttgtaaaataggtagtcgtaggtgttttgtaaggtgtgttattcgggtatgaagtttataagtgtttaatagatgtattcgtaagttttttaatttgttggttgttatattgtatgatttggaataaagtatgtatgaattagaggttatagattgaaattgttttagatttttatttttttatagtatttttatttttaaaagtattttgtttataaagggaaatagtagaattagtatttaaattaaggtagggttttagcggttttaagtaattttatttgaatttttgtttgaaatattgtagatgatttgggtttaaatgttattttagttatttagtaattatgtgattttgagtaggttatttaaagtttttgggttttgatttttttatttgtaaaataggtataataatagaatttattttaaggtagtgaggattaaattagttcgtgtttgaaaagtcgttaggatagggtttggtacgggaatcgttgaatgagtgttatttagtttagagtttatttttgtatattttgtttagatttggggtgattttgtttggggttaggatagggttggggtgttagtttgattgtagttttttgggtgttttagtttgtgaagttaggatgaataggtgtaattagttttaggtttgttgttttgttatttttgttgtggttataattttttttgtttttagatttttttatttttgggagaaggtagggtgagatgggggtagatgttttaatggattttatttatggttttgggaaagttgggttagtttatgggattatgttaaaagacggtaggttttatgtttaattttggaattggatgggataattatagggtagttagaaggtaaaattggagagtagcgaggggaatcgaggggatttgtttttcgaggagtagttagaatatttggttattattattaatgtagttgtaggatttggtttatttttataagttcgtgattgtttttaggtttttgttacgtattagtatttatttgttagggttgtcgtaggtgggtttgtattttgtgtattgtattaaggtgtttagttgagggttgagaggatttgaaatgtagtttatatttagttttttaatttaagagttttggagtaaaagattttttttgttatgtttttggggttaggtttgttcggagtggtttatttttttagttttattaaagttttggaatagtgtagtggtatttagttatttgaatttgtgagtacgtatttatagtcgattgagttgttattatattttggagtgttttttttttgggtttttttttggtttttatatttattttttatttttatttacgtgtaggttttagggttggttgggagttcgagaggggaatgttttggtaattgaataggtttatttttgagtgtggtttaaggcggttttttgttttattttagggggtttattagatgtttttggtagtgtgtttattttgggtaggttcgtggtgattatgggacgtcgggtttagggttttagtgtttttttttgtatgtattttaggagaaagagttatggaattggatattatatatttttttttttttttgttatttatttttttattgaatttttatttatgtttcgtaaggatttagatgtttagggatagtggggttatgtttgtggtttaaaataaaattttttgaagtggagcgtttagtttgttttgtatttggggttttttatagggaattttaattattgttgatgaat

SEQ ID NO: 325 - DNA, 4337 bp, Artificial Sequence
  chemically treated genomic DNA (Homo sapiens)
gtttattaataataattagggttttttatgaaggattttagatgtagggtaagttggacgttttattttaagggattttgttttaaattatagatatagttttattgtttttaggtatttgggtttttacggggtatgggtgggaatttagtagaggagtgagtggtaggaggaaagaggggtgtgtaatatttagttttatgatttttttttttaagatgtatgtaagggagggtattagggttttgggttcggcgttttatggttattacgagtttgtttaggatgggtatattgttaggaatatttaatgagttttttgggatgaggtaggaaatcgttttaggttatatttaagggtgagtttgtttagttattagggtatttttttttcggatttttagttagttttaggatttgtacgtaggtaagagtaggaggtgggtatgagggttaggaggaagtttagagagggggtattttagggtatagtggtaatttagtcgattatagatacgtgtttataagtttaggtagttaggtgttattatattattttagggttttggtgggattggaaaaatgggttatttcgggtagatttagttttaagaatatagtagaaggggttttttgttttaggatttttaggttggagagttgagtgtggattgtattttaggtttttttaatttttagttgggtattttggtataatgtataaaatgtaagtttatttacggtagttttgataggtgaatgttggtgcgtgatagaagtttgggaatagttacgggtttgtagaagtggattaggttttgtagttgtattggtaataataattaagtattttagttgtttttcgggaagtaggttttttcgatttttttcgttgttttttagttttgttttttagttattttgtgattgttttatttagttttagagttggatatgaaatttatcgttttttgatatggttttatgagttggtttagtttttttaaggttataagtggagtttattggagtatttgtttttattttattttgtttttttttaaaaatgagagggtttgagggtaaagggagttgtggttataatagaagtagtaagatagtaggtttggggttggttatatttgtttattttgattttataagttgaagtatttaaggggttatagttaaattaatattttaattttgttttaattttaggtagaattattttagatttgggtaagatgtatagaagtaaattttgagttgagtaatatttatttagcggttttcgtattaggttttgttttaacgattttttaaatacgagttgatttaatttttattattttgaggtaggttttgttattatatttgttttatagatgaagaaattaagatttagaaattttaagtagtttgtttaaggttatatggttattaagtggttgaggtagtatttgaatttaggttatttgtagtattttagataggggtttaggtagggttatttgaagtcgttagggttttgttttaatttaagtgttgattttattatttttttttgtaaataggatgtttttagaggtggggatgttgtgaggagatggaagtttgggatagttttagtttgtaatttttaatttatatatgttttattttaagttatataatatgataattaataagttaaagggtttgcggatatatttgttgggtatttataaattttatattcgagtaatatattttgtaaggtatttacgattgtttattttgtagatgagaaaggtggggtattgggagtagaaggtatttatttgtttagtggaagaaatgggtttgggatttaggattttttgaatttaaagtttaagtgttttaagaagagttggagaagtaatcggatggaagggaaaaggagagggaagggcggagggttgaaataggaggtggttatagaagtagatgtgaggattaggaaaggaatttagttaattaggatgttatttttaggttattttgaggaggggtcgcgtttaggatttgggaatgttagcgtttagagttgtttttattcgtagtttgttcgtttttaggatttgggaatgttagcgtttagagttgtttttattcgtagtttggtcgtttttagggtttggaggtttttttatgttggggtttggggttgtattggtaagttagggatggaggggcggagagggaggatcgggcgtttgttcgtttattatagttttcggttttgttgcgatttgttgggaatattagaattttagtgtttataggattgtaagtagtggtttttttttatttcgagtcgttttcgggggcggtatcgcggtcggttttggttagtattaaagataagtagatgggtaggcggatttcgtcgaaagtgtatttttttaagggaattaggggggacgatagagcgggttagattttatttttacgtagaaagaaaattgaagaaaggggttagcggttttatagtttttttttttttttttttttttcgcgtagcgttttgaaaaaagaaggggttttaatggatttcgtgttttcgataggttttttttttggttttttgttacggttattttcgtacgaggtacgttttcggtagttttttttttttcggttcgcgttttcgggttttcggtatttatttagaggtaggttgattcgggggttgagcgtttaggtcggaggcggcggttgtagtaggagtagtagtagtaggagtagtagtagcggtggtcgaggcggtagcgcgttttatggggcggcgagttagttttttaggtttatcgcggtgcgtagtattcggagagtaggagcgacggtgtttcgcggttcgggtttaggtggttcggtcggatttacgggcggtagtttcgtttcgcggttcgttttcgagtcgtttcgggggttttcgttttcggatttggggggcgggaggtgggaaatagggttaagtgggttttggtaaatttagttttttcgcggggtatcgtagttttttcgtcggcgtcggtttcgtagtttcggtttgggtagagtttattcgtaagcggcggagggcggggttgaaggaggaagtcggtcgtgagttcggtcggttcgtttttttttttttttttttttttcgggcgttggtagcgcgaggggcggtagttcggggcgttgtcgtaggggttaagttcgggattagtagtttcggcggtcgtcggagcgttgggacgcggacgaaagtcgatttttagtttttcgtttttattgtttagatttttttatcgtcgtttaggttttggtttttttcggtttttttgggattttttgttagtggcgttggtttggggatacgttgcgttttcgttatgcgtttagggagttagggggcggatggtgattaggttttggttttttttttttaggcgtttttttcgtttttgtttttggcgatttttttgtttttgcgattaaatgaattcggtcgagttcgtgttgatattggggttagtagtttgagagtttaatttttgtataggttaatttattgtaagttatggttgggtatttattataagtttagtatttagtttaggtattttgcgggtttgttcgtttaatattttgtttacgcgaagttttcgggtgggggaagggtaagattagtttaagtgggataataggatttaatgtattgttgaggaggtaaaatttttataatttgtacgtgattcggtaggggaagggaatttttaagattggagtggaagtttagaggtatttatttttaatttttttggtttttaatatttttacgggtggagtttagttttgttgagattaggggtttttaattgtagtttggattattagtagattttgaaattaatttagtggattttaatagtattaagaaataaataaaatatagaaattatttaagtaataattttaaaggataagtaattttgggaaagttattttaattttttttaagtgtgtataggattatagaaaaatgtagtagttttttttgtagttaagagtttaaaagagtgaaagtttttgttagttatttttatggtagtagagattatcgttttataaatttgttgtaattgtaggaaagtttttttttatttttagttaaaattagtttttttagagtattttttttttttttttttcgatttttagggtttgttatatttgtttttataatagggatgttgttaagagggtgggtatagtatttatatggttttaggtttttttttttatagttaagtttttttatgttg

SEQ ID NO: 326 - DNA, 4388 bp, Artificial Sequence
  chemically treated genomic DNA (Homo sapiens)
agttatgagtggattagatgttaaaatttttggttgagagaataattttattttggaggaaaatatattagttttgattttgagttgggaatttcggtgatgttgtagatttaatgtattgtagttgggtgtttttatttgttgaaaggaattgttgaatttttaaatttattaattgtttgttagtattagtaagtttaattagttaatattaagtaaatttgtattaaatatataattttggttgattttattggttacgtttggtagagggtagtagtagggagaaagttttgtagagtttttgttggaatcgtgtgaaaagttggagaggttgtttttttttttttttttttttttttttttttttttttttgatatatatatatatatatatatatatataattgtaataataataatattttggttttttattaagttaatttaaatcgtagaagtttattttgttaagtaagtttggttttagttatatgttgttatttagagaatttaatattagattttatttgattgtaaacgtgaattattaggttgtataaggaatatagtggtagatttagggggtatttaatttttatagtattttaaatgaaaaaaaaaaaaagtaatatttaaataagtaatttagattatgttgtaggttttgaatagttttgatgttgtgtttttatggtaagtttttaatttgagttgaatttttttttattaaaaatgtaaatttttttaagatttttttttggttttgttatttatgatatatattttttttaaaagaaattttaaattagataatagttgtttttttttttattttcgttattagtagtgtggtggggtagtagagttgtggttagtggaggagagtagaggaggagagtagggaaaggagaatgttatttgtttatatttttttttgtttatttttcgttgtttatttttttttttgtttttttgaacgtgaattgagttttgggtattgttttaggtttagtaggggataggataaagtttgtttttttaggaattcgtattgagggtgtgagtgtgtgtacgtgtgtgtttggaggcgggagaataaatataaataaataaaaaggagaattttaggtagtgataagagtgttgagaaaaatagaacggtgtgaaagaggaaggttgagtttgtagaggtttgaggttgttgttattgggtagcggtaggttttttcgaggaggcggtatttgaagatcggaggaaggtttattttagtaagtaggaatagtaagtgtaggttttttaagttttgggggagtttagtttttttaagggtagtataaaaattagtgtggtttcggagagtatattaggggagagaggtaggaagagtttggagatatggatggaagttggattagttgggttttgttgaatatggaaaggtatttagatcgtattttgagttaaatgggaagtgacgtgagagatttaataatggagcgttttgaattgttttatttatttaaaatatttatttttgtttggttgaatattttatgttgtttttttagaagttttggcgattttatttgaatgtatttaggttttattggaggggaataggattttatttgaggttacggaggtttatggaagttatttgtatagtaaatattttgaaagtggttgtagggagagtgtgagggtgggatcgttttggtaggaggtggaaaatgaaaaatatacggttatgagttttagattagggtttttgaaagtttttagtttttttagtttttattttaaagtgggtttttaaataggaagaaagaaagattgttaagtgtttttggagttttttttttttttttttttagggattttagtatttttggggttcgggttggttttaaagtagttttttttgtgtttttttatttatagtaataaaggtatggagtatttgtatagtatgaagtgtaagaacgtggtgtttttttatgatttgttgttggagatgttggacgtttatcgtttatatgcgtttattagtcgtggaggggtattcgtggaggagacggattaaagttatttggttattgcgggttttattttatcgtattttttgtaaaagtattatattacgggggaggtagagggtttttttgttacggtttgagagttttttggtttttatacggtttagataatttttgttgtattttatttttattatgtattattttagttaaattttgttttttgtatatatttcggtatgtatttaatattaatggttttttagatgagtggttatttatttgtttgtttagtttttagtggtatattttttgttttttgttgggaatagttaaagggattttaaggttaaatttttgtaatagtttttttttttttttgttatgttattaagcgtgaggattttcgtagttttttatagttgaatttagtttatgggttggggtttagataattttgtgtatttaagttatttgtagagatttaggtttggagagtagatattttgtttttgataagtattttttaaatggttttaagaataagttatagtaaagaatttaaagtggtttttttaattggtgatttggagaaagttaggttaagggtttattatagtatttttttgtatttttatggtaatgtatttttttatgaaagtggtatattttaaagtttttatatgattgtagtagagtatttggtgattgttaatttattttttttataggaatataaggggtatatagggaaggtagattttttagttggtaagattattttaatttgatatattgtagatttagatgtgttgaaagttttgtttttggtttttcggttatgggttttagttaatttatgttttttatggatttatggagagtagtaagttgattttagttaagtttttttatatgagggataagtttttgatttttgtttttatttttgtgttataaaagaaagttttttttttttgaatttgtagtaaggttagttttaggatttgttttagtgggtattgtatttggattttttcggcgtgtgtgtgttttatataggggtgaattgtttattgtggtgatgtatgatgagggtaaatggtagttgaaaggagtaggggttttggtgttgtatttagttttggggtatggagttgaatagtatttgtgtaggattgttgtggttattagagaataagagggaaagtagggtagaaattggatatagttttgaggtatagttagatttgtttagggtggttttgttataggttgtagttatttaggaatattttttgtagatttcgtattgttttttgggggtgttttgggatttttggggtagtttagtttttttttattttttagcgtggttttggttggaagaagtagttgttatagttgttgtagatagttgtgtttttataattggtttagtattttggggtacgggagaagggtggggatcgttgttgttattatttaggttgattggggtttggttagattacgtatgtttttggtggtttagagataatttaaaattagggtttggtttggggaagaaaattttttttttttttttttcgtttcgttttttatcgtttttatttttgttagtttattttttttaattttttttgatttataggttaaaaaagaaaggtttattttagttatagggtagttttttttgggtttttgtttttttagtataattatgggttatttttttttttttaataaaaaagaatgtttgattttttttgggtgattttattgtttgtaattgaaattttattgagaggtgatgtttgtgttagttaatgatttaggtgagttgttcgggttttttttggtatgttttgtttggaaaagtggattttatttatttttgattgtttagttaagtgattattaaaggattgagaatttgggagggtaaaaaaaaaaaaaaagtttttatgtgtatttaaatttggggataattttatgtatttgtgttaaggatatgtttaagaatataatttttttgttgttgtttgtttaagaagtattttagtttgtttaagaagtattttatatagtataatatatatttttttgaaattatattgtttgtttattagataattgaatgtagtaattttgttttggatttaatttgattgggttaatatgtaaaaattaaggaaaaatatttagtttttttttttttttttgtatattttttaagttattttgttatgtatatagttatttatgtttaaagtttggtgattatttatttaaatgaagattatattttatattaatttttgtatttatagtagataaaatagtat

SEQ ID NO: 327 - DNA, 4388 bp, Artificial Sequence
  chemically treated genomic DNA (Homo sapiens)
gtgttattttgtttattgtggatataaaagttgatatgaaatgtgatttttatttaaatgaataattattaggttttaggtataaatgattgtatatatgataaggtagtttgaaaagtatataaaaaaaaaaaaaaaaattaaatatttttttttggtttttgtatgttaatttagttaaattaaatttagaatagaattattatatttaattgtttgataaataagtaatgtaattttaaaaaaatatatattatattatataaggtgttttttaaataaattaaggtgttttttaaataaatagtaataaaagaattatgtttttaaatatatttttaatatagatatataaaattgtttttaaatttaagtgtatataaaaattttttttttttttttgtttttttagatttttagttttttggtgattatttaattggataattagaaatgaatgaaatttatttttttaaataagatatattaagagaagttcgagtagtttatttgggttattggttaatatagatattattttttaatagggttttaattatagataataaggttatttagaggaaattaaatatttttttttgttaagaaaaaggaagtaatttataattgtgttagagaagtaaaggtttagggaaggttgttttgtggttggaatgagttttttttttttagtttataggttaaaggaaattgaaggaaatgagttggtaggagtggaggcggtagggaacggggcgggggaggaagggggaggatttttttttttaaattaaattttgattttggattatttttaaattattaagggtatacgtaatttgattaggttttagttagtttgagtagtgatagtaacggtttttatttttttttcgtgttttagggtgttgggttaattgtaggaatatagttgtttatagtagttgtgatagttgttttttttaattagggttacgttgggaaatgaagaagagttggattattttagggattttagggtatttttaaagggtaatgcggggtttgtaaggaatgtttttaggtagttgtagtttgtggtagggttattttgagtaagtttggttgtgttttagaattgtatttagtttttgttttatttttttttttgttttttagtagttataataattttgtataagtattgtttagttttatgttttagggttaaatgtaatattagggtttttgttttttttaattattatttatttttattatgtattattatagtgaatagtttatttttgtgtaaggtatatatacgtcgggaagatttaagtatagtgtttattggaataggttttgaagttgattttattgtaagtttagggagggagggtttttttttgtaatataaaaataaaaataaaaattaggaatttattttttatatagggagatttaattaagattaatttgttgttttttataggtttatgggaggtatgaattaattggaatttatgatcggaaagttagaggtagagtttttagtatatttgaatttgtagtgtattaagttaaaatagttttgttaattaggggatttgttttttttgtgtgttttttgtatttttatagggggaatgaattgataattattagatattttgttatagttatataaaagttttaaggtgtattatttttataaaaggatgtattgttataggaatataagagggtgttataataaatttttgatttagttttttttaagttattaattaaaggagttattttaaattttttgttgtggtttatttttagagttatttaaaaagtgtttattagaggtaaaatgtttattttttaggtttgggtttttataagtagtttaaatgtatagagttatttgagttttaatttatagattgagtttagttgtgaagagttacgggaatttttacgtttagtaatatagtaagggggaaagagagttgttataaagatttagttttggaatttttttggttgtttttaatagaagatagaagatgtgttattaagaattgagtaagtaaatgaatggttatttatttagaaagttattggtgttggatgtatgtcggagtgtatgtaggagatagaatttggttaaagtggtgtatgatgagggtaaaatgtagtagggattatttgaatcgtgtgggagttagggagtttttagatcgtggtagggaaattttttgtttttttcgtgatgtaatatttttgtaaggaatgcgatgaagtagagttcgtagtggttaagtggttttggttcgttttttttacggatgtttttttacggttagtgggcgtatgtaggcggtgggcgtttagtatttttagtagtaggttatagaggggtattacgtttttgtattttatgttgtatagatgttttatgtttttgttattgtaggtgggaagatatagaaaggattattttagagttaattcgagttttaggagtgttgaaatttttagaaggggaaggaagaggaattttaaagatatttagtaatttttttttttttttgtttaaagatttattttaggatgggagttgggaaagttgagggtttttagaagttttaatttggaatttatggtcgtgtgttttttattttttattttttattagggcggttttatttttatattttttttgtagttatttttagggtatttgttatgtaggtgatttttatggattttcgtggttttaaatgagattttatttttttttaataggatttaaatgtatttaaataggatcgttaaagtttttaaaaagataatatgagatatttagttaagtaggagtgggtattttaaatgagtaaagtagtttaagacgttttattgttaaattttttacgttattttttatttaatttagaatacgatttaaatgtttttttatgtttaataaggtttaattggtttagtttttatttatgtttttaagttttttttgttttttttttttaatgtgtttttcggagttatattgatttttgtgttgtttttaaaggaattaagtttttttaagatttaggggatttatatttgttgtttttatttgttgggatgaattttttttcggtttttaaatgtcgttttttcggaaaggtttatcgttatttagtggtagtagttttaagtttttgtaggtttagttttttttttttatatcgttttgttttttttagtatttttattattgtttgaaatttttttttttatttatttgtgtttattttttcgtttttaaatatatacgtgtatatatttatatttttagtgcgaatttttagagaagtaggttttattttgttttttgttaggtttaaaatagtgtttagagtttagtttacgtttaggaaaataaggggggaaatgggtagcgggaaatgggtagagggaaatgtaggtaaatggtatttttttttttttattttttttttttgtttttttttattagttataattttgttgttttattatattattggtggcgggggtggggaggagaataattattatttagtttgaaattttttttaaaagaaatatgtattatgagtagtaggattaagagaaggttttagaaaaatttgtatttttagtaggggaaaatttagtttaagttggagatttgttatgaaaatataatattaaagttatttagggtttatagtatgatttaaattatttgtttaagtgttatttttttttttttttatttaaaatgttataaaagttaaatgttttttggatttgttattgtgttttttgtgtaatttgatgatttacgtttatagttagatgaaatttgatattaaattttttgagtagtaatatatggttggggttaagtttatttaataaaatagatttttgcgatttagattggtttagtgaggaattaaaatattattattattataattgtgtgtgtgtgtatgtgtgtgtgtgtgttagagagagagagagaaagagagagagagagaaagagaagtaatttttttagttttttatacgattttaatagaaattttatagagttttttttttgttgttgttttttgttagacgtggttagtaaaattagttagggttgtatatttagtgtaaatttatttagtattaattaattaggtttgttaatgttgataagtagttaatggatttgaaaatttagtaattttttttaataaataaaaatatttaattgtaatgtattgaatttataatattatcgaaatttttagtttagagttaaagttaatatgtttttttttagggtaaggttatttttttagttagggattttggtatttaatttatttatggtt

SEQ ID NO: 328 - DNA, 4200 bp, Artificial Sequence
  chemically treated genomic DNA (Homo sapiens)
gaaaatgagggttggttttgaagttggatagatttgtttgatttgtttgtttttagtttgggttaattatattgttttagtaagttatttatattgtttttatatttttgaaatgaggtatatgtttgttttatttgggaatgtgaggattaaggagaataatatatatataatgttgaatatttatgttttttaattattttgaagttttagaaatatttttagtttttaggtgagttgtgattaaatttgtttattaatttaatatatatttattgaatgtttattttgtgttgtagtttttggtaggtgtgtttgatagtgggtgtgtaatatgtttagggtttgtattttatgagtgtggggattttttttattttttggtatatatggttttgggggagaagttaaggggaagggttaggagtttatatggtagatttagtaagtttttagtataataattttaattgtaaaaataaatagttttgttaattgtttgagagtagtgtttgttttataaaaattaataataataaaaggaaaaaaaatttaaagtaaaatgttatatttaatggttgttggataagatattgttgtataaagttttgtgtgagattgttttggtgttgttttagtttgtttttgggggttatagaggaaggtgtggggtgtgtgttagttataaaagattgttttgaattttagggtagtgtttatttattgggtggttttagaagattttttttaaagtgtggttgataagggtgatagtgtttggattgtgggaattgtttgtggagttggtgttgaatagggtgtgtgtggtgggtgttttaaggaaattggaagtgggattggaggttggtttttgggtgtgtgaggaggagttggaagaagagtggggaggggaatggtttggaatttgtgtgtgttgaatggtggtgttttaatttataaatttattttttgtttagagagaagtgaaggagaggtttagtgagtaaaagttgaggtttttgagttgttttttggtgtgtgttttttgtttgaggtgtattttgttgtgttgtttttttttattgttgtgtgtgaagtggtggttgtatatgttgtaagtaaaaggttttttgttggtgtgggtgtgtatgtgtgtggtgaggtggttgttgtggttgaagttgtggaggtagatgtggtattggaagggtttgtggtttgtgtggatgtgtaggtggtgattgagtttgttggagtgtgtaaagttttgtatataattttttattgggtaagtgaaggttttggtgtgtggttgtgggtagaagtagtgtgtgttgtatttgttgttgtggtgttttttgtgttgtgttttggtttgggggaaaggggtgggtggtggtggtggtatgggtggtgtagttatgttattgtttttagggatgtttgttattagaggtttagggaagtttgttgtggtggtgttgtgaaggtttagtggggaaagttgaggttgtgtattggttagaaattttttgttgttgttgttattttttttttttttattaggaggggttaggagtttagggaggtttttagtttttttttttaagttatttggggttagtgggaaagtgttataggttttgttgggatagagtttgttggttgggatggttggtagttttgtagggtagttgatggatagtaagtttttaattttggtttttattatgggaaaatgagtttttggggtggtttggtagtttttttgtgatttatagttttttggggtttttatagaaagtagtttttagggtgtgtagggatttttgaaggtagagatagtgtttagtgttggtgaggtgggaggtgtttggaggttgggtttgatgttgggtggggagagttgaggtttatataggtattgtgagggggtatttgtgtaaggtgaggttttttagaatgtttttgggaaaggggtagtgtttagatttggggagtaaaggtttggtggatttggtagtaaggtattggattttgtaggaaaaggggtatttagtggggatttggatgttgttgtttttggattggggaagggtgttaggtttaagatgtttgatatgaggttgaagagtgtttttgggttgtgtgggtgtttgggtattgtttgaatgaagaagttattgttgtagttgaggttgggagggggtgtgggtgtaggtttttttaggaagtaggagttggttaagtttttatttgtgttgtagttgtttaaagtttagtttaagaagttgtttgttgaggagggagtaggaattagttttgggtatattaaagggtgtatttgagtttatagtttttatttataaaatttttggtgtttatggatatatataaagtgttttttgtatattttgatttagtaggggtttgtatatgttttaaggagtatatagaaatatgtatatgtaaaatatatgtgtataggtaaaagggtgttttgataattgtataggtttttgtggaggtgttggtggtttagtgtgggtgggaatgggggtgtgtattttaggatttttaagttttttattgtttttatttttatagttttaatgttttagttttttttggtttttaggtatggtgtgtttttgtgttgtgttgttgttgtttgagtatttttgtttgttttttttatttttagggtagttggtggttgtgggagtgtttttggtaggtagttggggtaatttagtgttgggtttggtgtaatagtttttagtggatttgatgaggagtgtgttgggtttggaaaatttgttaaggtggagtatggtgtggtgttggttgtggggtgtttggggttttgtttgttgggtttgggggtgtgtgggtggtggggaggttggtggtaggggttttttgtagtgtatagatttaggtgtttgggtttttggttttgggtatttatttttgggaaaggagttggggagttgtggtgtttttgtttgtttgtattggttttgggtggtggttttttgtttttttaaagtgttgttgggtttttttagtttatagtttttttatttatatagttgtggtggtgttggttttgggtttttgattttttgggttattgttattttgggaggttttggttttgttgttgtgatgtaaatgtttaaatatggatataggatgtgtgttggggatttttgaaaaggaaagtttgagttgtgatgttgttgttgttgttgttgttgttaggtttgtgttgttgtgtgtgtgtgtgttttttaggtgtggagtgttggggttgtggatgtgttagtttggggtgttgtgttttattgggttgattgtttggtagatgtgttttttatttggaggtagaggttgaggggtagtaggggaggattgtgttgggtttgaatttgttttttgttattaattagtttgatatttagttttttttaatgttagttttttatttgtgtattttttgtggagagaaattgagagtatataaatgtttaggtgtatttagtaaattatagagattattgttatttattttttttgtttatgtttgtgtgtttttttattttaagttttttttttttaaatttgtgttaggaaaaataatttaaattaaaaaggattgtaatatttgttaatagtaggaggaaagttaattagtataatagggtatattttaaattgaaaagtaaaagttttttttttttatttatttttatttttagtttttgaggtagttatatttaagttttttgggtatttttttagaagaattttatgtatatttaattatatatattgttttgtaatattattattattattatttttttatttgaaataatttagagattgtgttatgttttgatataaagattttgttatttttttttaaggttgtatagtattttattgtaagggaggattttgagttagttgatttgttttttatttatgagtatgtaggtagtttttaattttttatttatattaatgttgttggagttaatatttttgattatataaatgtgaatgtgtttgtgagataaattttaatgagtgtaattgtgtgttaaagtatatgtaaaattttgatagataattggtaaattgttttttagaaaagtagggttaatttttgtttattttttttttatttat

SEQ ID NO: 329 - DNA, 4200 bp, Artificial Sequence
  chemically treated genomic DNA (Homo sapiens)
gtgggtgagggaggagtgagtaggaattggttttatttttttggaagataatttgttagttgtttattaaaattttatatatattttggtatataattatatttgttggaatttattttatagatatatttatatttatatagttaaggatgttgattttaataatattggtataagtaaaaagttggaaattgtttatatgtttatggataggggataaattgattaatttaaggtttttttttataatggagtattatatagttttgaaaaagaatgataagatttttatgttaggatatggtataatttttaagttattttaagtgaaaaaataataataataataatattgtagaataatgtgtatggttggatatatataaaatttttttgaaagaatatttaagaaatttaaatgtggttattttaggagttaggaatgaaggtaggtggagaggagggatttttattttttaatttagaatatattttgttgtgttagttgattttttttttattgttaataagtattatagttttttttaatttaaattattttttttagtataaatttaaaaaaaaaaaatttaaaatggaaaaatatataggtgtgagtaaaagaaatgaatggtaataatttttgtggtttattgagtgtgtttggatatttatgtgtttttagtttttttttataggaaatgtataggtgagaaattgatgttaagggggattgagtgttaagttagttagtggtagagggtagatttaaatttaatatggtttttttttgttgttttttggtttttgtttttaggtgggaagtgtatttattggatggttggtttggtgaggtgtagtgttttagattggtgtatttgtggttttagtgttttatgtttggggagtgtgtgtgtatgtagtggtgtgagtttggtggtggtggtgataataataatgttatagtttgagtttttttttttgggagtttttggtatatattttgtgtttatgtttgggtatttatgttatggtggtagggttggggttttttaaaatggtagtggtttggggagttggaagtttggagttagtgttgttgtagttatataagtgggggggttgtgggttgggggagtttggtagtgttttggagaggtgaggagttgttgtttgaggttggtgtgggtgagtgagggtgttgtggttttttgattttttttttagaggtgagtgtttgaagttaggagtttgggtgtttaggtttgtgtgttgtggggaatttttattgttagtttttttgttatttgtgtgtttttaagtttagtgggtgaggttttgggtgttttatagttggtgttgtgttatgttttattttagtgagttttttgaatttgatgtgttttttgttaagtttattgaaggttgttgtgttgaatttagtgttgaattgttttggttgtttgttagggatgtttttgtggttattggttattttggaggtaaggagggtgagtaggggtgtttagatgatgatggtgtagtgtgggggtgtattatatttgagaattaggagggattgggatattggagttatgagaataggggtgatgggaagtttaggagttttggggtgtgtatttttatttttatttatattgggttgttagtgtttttgtaggaatttgtgtggttattggagtgtttttttgtttgtgtatgtgtgttttgtgtgtgtatgtttttatgtgttttttgggatgtatgtgggtttttgttgaattagaatgtgtaaaaggtattttgtgtatatttgtgggtattaagagttttgtaggtaggggttgtggatttaggtgtattttttgatgtgtttagagttgatttttgttttttttttagtaggtgattttttgagttgggttttgaatagttgtggtgtaagtggggatttagttgatttttgttttttggaggggtttgtgtttatatttttttttggttttagttatagtggtagtttttttatttaggtagtgtttgaatatttgtatgatttggaggtattttttaattttatgttgggtattttaggtttggtatttttttttggtttagaggtagtagtgtttagatttttgttggatgtttttttttttgtggggtttgatgttttgttgttgggtttgttggatttttattttttggatttgggtgttgttttttttttagaggtgttttgggaggttttgttttgtgtgggtgtttttttgtagtgtttgtatgagttttagttttttttgtttgatgttaagtttggtttttgggtgttttttgttttgttagtgttggatgttgtttttgtttttaagggtttttatgtgttttgggagttgttttttgtgggggttttagggaattgtgggttatagggagattattaggttgttttggaggtttgtttttttgtaatagggattaagattgaggatttgttgtttattagttgttttgtggaattgttggttgttttagttaatagattttattttagtggggtttatgatgtttttttgttggttttgggtgatttaggggagggggttgagggtttttttgggtttttgattttttttagtggggagggagggagtagtggtgatggtggagagtttttggttagtatgtagttttagttttttttgttgggtttttgtagtgttgttgtggtggatttttttaaatttttggtggtggatatttttggaagtagtggtgtggttgtattatttgtgttgttgttgttgtttattttttttttttaggttaaggtgtgatgtaaggggtgttgtggtggtaaatgtagtatgtgttgtttttgtttgtggttgtatgttaaggtttttgtttgtttggtggagagttgtgtgtggagttttgtgtgttttgatgagtttaattgttatttgtgtatttatatgggttataaatttttttagtgttgtatttgtttttgtaattttagttgtagtgattattttattatgtatgtgtgtatttatattggtgagaagttttttgtttgtgatgtgtgtggttgttgttttgtgtgtagtgatgagaagaaatggtatagtaaggtgtattttaagtagaaggtgtgtgttgaggagtggtttaagggttttggtttttatttgttgggttttttttttgtttttttttgagtaagagatgggtttatgggttggggtgttgttgtttggtgtgtatgagttttgggttgtttttttttttgttttttttttaatttttttttgtatgtttgagggttggtttttggttttgtttttagtttttttgaagtgtttgttgtatatgttttatttagtattagttttgtggatagtttttgtggtttaggtgttgttatttttgttagttgtgttttgggggaagttttttgagattatttagtgaataggtattattttgggatttaagatagttttttgtaattggtatatgttttatgtttttttttataatttttagagataggttggggtagtgttaaggtggttttgtgtgggattttgtatagtagtgttttatttagtagttattggatgtaatgttttgttttgggttttttttttttttgttgttgttaatttttgtaaagtagatgttatttttaagtagttgataaaattgtttatttttgtaattaaaattattgtgttaaaagtttattgaatttgttatgtaagtttttgatttttttttttagttttttttttaggattatatgtgttagaagataaaggagatttttatgtttatgggatatagattttgaatatattatatatttattgttaggtatatttgttaggaattgtggtatagagtaggtatttagtaaatgtgtgttgggttaatgaatgaatttaattatagtttatttaagggttggaggtgtttttggaattttaaagtggttaaaaggtgtaggtgtttaatattatgtatatattattttttttaatttttgtatttttaaataaagtaggtatatattttattttaaagatgtggaagtaatgtagatagtttgttggaataatgtagttaatttaggttaggaatagataggttaaataaatttgtttaattttaaagttaatttttattttt

SEQ ID NO: 330 - DNA, 4491 bp, Artificial Sequence
  chemically treated genomic DNA (Homo sapiens)
tttagtaattttttatgttgaaatttggtttagtatattttgattatatatttatatttaattatagttttaaaatagttaagtagttttaaaaatttaaattaaatttttgtggaatttttaaaaataagaaaaatattattgagtaattggtaatataaaatataaaatgtttaatttggtttttttttagatttgaagtatagtgattaatgaatatataatggttgtagttttttttataattatgttatttaagttattgatgaatatttatgatatatgtagtaaaaatttagataaatattttggttataaattggtttattaaataatagtttgtattatagtttgagttaagagtaataggtttataattgtgttttagggtattaagaagtttttttgaggattttttaaaaggtattttttgttttgaaagattgttttttttttggaagttttaggttttatgagaaattatttattttgaatttgttataaaaaatgatttgtaaataagttttgtgtagtgaattatgtgtttttagtaagaggattttgaaagttttttgtaaaatgaagttatttttaaaagagagttatttagaatataattaaattgatttatatgtttttatttattttaaatatgaagggaaattgtttttaaatatatttaaatttttaatagaatagtagtatgttattagtgtggaaataatttatttgttaaataaatatttggggtgtatttgttgtatattaggtattgtaatatagggattaatgaaagagaaaaaaaataaagtatgaaaggatagtagaaatagttttataattttattttttaggaataatttttatggatattttgttgtgtgtttattgtttttttaatatatatattttttaattaaatggaattgttttaaatatgttatttaatagtttgtttttttttatattatttgaaaattaagaaatgattataatatgttttatttaaaaattttaagtttaggttgggtatagtggtttatgtatgtaattttagtatttggagggattgaggtgggtggattataaggttaggagattgagattattttggttagtatggtgaaattttgtttttattaaaaatataaaatttagttgggtatgatggtatgtgtttgtagttttagttatttgggaggttgaggtaggagaattgtttgaatttgggaggtggaggttgtagtgagtggagattgtattattgtatttgtttggtgatagagtaagattttattttaaaaaataaataaagaaaatttgaagtatagtatttttttaaattttaaatagataatagaaattggtttttttttatttaaattagaatttaagtttaattttatatatttttgatagtttggattttgttttttaattttataaaattgggaatttaagtattatttggtttgatttaaatgtaatgtagaatttgtattaaaatattatattaaagttttagatttgtagtagttaatagtatttttatgtatgtgttagggattgttttaaatattttatatatattaatttttttattttgtatttttgtttttgttttatatagtaggaaattgaaatattgagaggttaagtaattaaagttatagagttagagtgataggagtaaagttttaatttaggtaatttagatttttagagttttgatttttattattaagttgttagtatagtttttttggtaattatttttaatttaaatataatttgagtgatttatttaataagttattattttgataatttagtgatttgtaatgtaaaattatttattgtaatttatttaatattattgtttttttgtgttgtaaaaattatagtaattgagatgtaatttattatttttttttttatttttggtattttgtgttaatttttttgttttgtggattttttttgattttttattatgtgtgttaattgttattaatttttttgtttgttggggattggggttgtgagggtatatttttgaggggtatggggttagggttaggtaggttgtgtggttgggtggggttttgtgttttattgtggagtgtgggttgggaagtggagagagaagtagttgtgtaatttgttggatgtggattagggtgttttttatttttgttgggagtttgttgattggttgggtgtgggtgtatgtgattgatatgtggttgtattggtgtagtttgttagggtgttattggagatagaatggaggtgttgttggatttggaaatggggtaggtgttggagttattatggttaggtttgttgtggggggaggggggaaggtggtttttttttgtattgttttaaattgatggtttttttttggtatagggtttattgtagtatgttaaatgaggaggtaggggtgttgtttttttgttttttattgtagtattggagatggattttttgtattttggatttagggtttttgatagaagaggaagaagggggaggggtagaagtgttaaggggagtttgttgagaaaagttgtttttgaagttagaaggggtttttgtttttataatgttatttgatagagtggaataatagtatttaaggaaatgggtagaggataataaagaatggagtatatttatggtgaggagtaaaagttttattttattgaaaggtttttttttttttttggtgataaggatatatgtattggtggttaaaagagagaggagataaaattgttgtagatggttgatgtgaatttagtggaaagagttattggggatgagagaaagaggaggaggtaggtattgtagagtgtgagtggtggtgttggttggtgaaatattggttattagtagtgtgtttgtttttgtaaaatatttaagtaaattttttgtgaatagggtggtaaatagatattagtgtttttgttagttataaaatgtagtggtagtggttttttgtggatgattgtagtagtgttttttttttttttgttaggttgaaaagataattgtagaggaataagaaattttgtagtaaatgttggggtagaagtttatttataagaagttatagtttataaatgtagtttgaatagtagaaaaaaaattattgttttttaaagtaggaataatgttaggttatgaatgttttgttattggaatgtattggatattttgattttatattatgaaagtgatgtttaaattttttgatttaatataaattttatatgaaattttaataaattatgtatgaaatagtggatttttttttttgttagtgaagtttttatgttattaattaggttatttaagagtaaattattttataatgtaaattattttgttaaaaattatggtgaataaatttttgtaggtttaatatttaagatttatagttaagtaattttatatttttttttggttgtttttagataatattgaataaatatttaagatattaatttagtgtgtaaatattttaaattaaagtaatatggttttttttttagatgtatttttgtttagtgagtatttatgagatatatttttgatataaagtgttttttattgagttttttttttttttatttaaatgtaaaagtttatttttatgtatatttatagtagttagtttgttatatttttttattttttgaataaggatggtagtggttttgtaaagttttttagggttagtgatagtgttttttaaataatgtttatgtaatagaaagttttaagatgatttattatattgttttagtaatatttttaagataatgtggaattgggttggtttagataaataagattatataagttttttattgataaatttaaatagttttttaaaaaattatttttgttttaagaattatttgattatggatattagggttaatagtatttaggagttgggtgtggtggtttatgtttgtaatataagttaaataggaggttgagggaagttgaggtaggaggattatttgagttttggtgtttaagattagtttgggtaattaagtaagattttattttaaaaaaaagtatttagagttttttttttaaaatttgatggaaattatggttagaattaaagatgttatattaaaattttaaatgatatttaatagttaatattatttagttttttgaattttattagtatagtgtttgagagtttataaaattattatttttatataaattattttttattattttaatagtttattgtagtattatttttattttaaatgttagagatttttatttaagtatgttgtgattttatttaaggttaaatattgtataataatgtaaagaatttaagttttttattttattttaattttataaaattataatgttttttattatatatatataaaataatatataatagaggtaatttgaaaaatagtgtaagttattgat

SEQ ID NO: 331 - DNA, 4491 bp, Artificial Sequence
  chemically treated genomic DNA (Homo sapiens)
gttagtgatttatattgttttttaaattatttttgttatatattattttgtatgtatgtaataaaaggtattatagttttatagaattagaataaaatagaagatttaagttttttatattgttatataatatttgattttggataaagttataatatatttgaataggagtttttaatatttaaaataaaaataatgttataatgagttgttaaaatggtaaaaggtaatttatgtaaaaataatagttttatagatttttaaatattatgttaatggaatttaaagaattgagtaatattagttgttaaatgttatttggaattttaatgtgatatttttagttttagttatagtttttattagattttaaaaaagagattttaagtatttttttttgagatagggttttgtttggttgtttaggttggttttgaatgttaaggtttaagtgatttttttgttttagttttttttagttttttgtttagtttgtattataggtatgggttattatgtttggtttttaagtattattaattttgatatttatgattaagtaatttttaaagtagaaataattttttaaagaattatttaaatttattagtgaaaaatttatgtagttttatttatttaagttagtttaattttgtattattttgaaaatattattgaaataatataataggttattttaagattttttattatataaatattatttaagagatattgttattgattttggagggttttataaagttattgttatttttgtttagggagtggggaggtgtggtaggttggttattataagtatgtataaagataggtttttatatttaggtaaaggaaaaaaaagtttaatgaaaaatattttatattaagagtatattttatgagtatttattaaatagaaatatatttagaagaaaagttatgttgttttaatttaaaatatttgtatattgaattaatattttaaatatttatttagtgttatttaaaagtaattaaagagaaatataaaattatttaattataggttttaaatattaggtttataaaaatttgtttattataatttttgataaagtaatttatgttgtaaagtggtttgtttttgaatgatttaattaatggtataaaagttttattaataaaagaaaagatttattgttttatatataatttattaagattttgtataggatttatgttaaattaaagaatttgagtattatttttgtgatgtagaattaaagtgtttaatatattttaatgataaaatatttatagtttgatattatttttattttaaaaaatagtaattttttttttgttgtttaggttgtatttataaattatggttttttgtaaatgggtttttattttagtatttgttgtaaggttttttatttttttgtagttgtttttttggtttaatagagggagaaaaagtattgttgtagttgtttgtaaaaagttattattattgtattttgtaattaataaagatattggtatttgtttgttattttgtttatagggagtttatttagatgttttataaaagtaggtatattattggtgattagtattttattaattaatattattatttatgttttgtagtatttgttttttttttttttttttatttttagtagttttttttattagatttatattagttatttgtagtggttttgtttttttttttttttggttattaatgtatgtgtttttgttgttagggaggaaaagaagttttttaatggggtagagtttttgttttttgttatgaatatgttttattttttgttgttttttatttgtttttttagatattgttattttattttgttaaatggtattataaaaataaaaattttttttggttttaaaaatagttttttttagtagattttttttaatatttttatttttttttttttttttttttttgttaaaaattttggatttgaagtataggaaatttatttttagtgttgtagtggggggtggggggatgatgtttttgtttttttgtttggtatgttgtagtggattttgtgttaaggaaaggttattggtttaagatagtgtgagggaaaattatttttttttttttttttgtagtaagtttggttatggtggttttagtatttattttatttttgagtttggtagtatttttattttgtttttagtgatattttggtgggttgtattaatatagttatatgttggttatgtgtgtttatatttagttaattggtgggtttttgatgggaatggggagtgttttggtttgtatttagtggattatatagttgtttttttttttgttttttgatttgtattttgtagtggggtatagggttttgtttaattgtatagtttgtttagttttagttttgtattttttgggggtatgtttttgtggttttagtttttagtaagtaaggaagttgatggtagttgatatgtatagtaaagagttgggggaggtttgtagggtagaaggattagtataagatgttggaggtgggagggagagtaataaattatattttgattgttatgatttttgtagtatagagaaataataatattaaatgaattataatgaataattttatattataagttattgagttgttagagtgatgatttgttagatagattatttgaattatatttgaattaaaaatagttattagaaaagttatgttagtagtttagtagtggagattagaattttggaagtttgggttgtttgagttgaagttttatttttgttattttagttttgtaattttagttatttaattttttagtgttttaattttttgttgtataaaatgggaatagaagtatagaatagaggagttaatatatatgaagtatttagagtagtttttgatatatatatagaagtgttgttagttattataaatttgaggttttaatgtagtattttaatgtaaattttatattgtatttaaattgaattaggtgatgtttaaatttttaattttatgaggttgaaggataaaatttaaattgttaagaatatataaagttaaatttaaattttggtttaaatggggggaaattagtttttattatttatttaaaatttaaaaggatattatattttaagttttttttgtttgttttttgagatagagttttgttttgttattaggtgagtgtagtggtgtaatttttgtttattgtaatttttattttttgggtttaagtgatttttttgttttagttttttaagtagttgggattataggtatgtgttattatgtttagttaagttttgtatttttagtagagatggggttttattatgttggttaggatggttttaattttttgattttgtgatttgtttattttggtttttttaagtattgggattatatgtgtgagttattgtgtttggtttaaatttaaagtttttaaatgaagtatattataattgttttttaatttttaaatagtatgaaaagaagtaagttattaaatagtatatttgaggtaattttatttgattaaaaaatgtatatattagaaaagtaatagatatataataaaatgtttatagaggttatttttggaaagtgagattatggagttatttttgttgtttttttgtgttttgtttttttttttttttattagtttttgtgttataatgtttgatatatagtaaatatattttaaatatttatttaataagtgagttatttttatattgatggtatattattgttttattaaaagtttaaatatatttagaaataatttttttttatatttgaaataaataaaagtatgtaaattaatttgattatattttaaataatttttttttgagaatgattttattttataaaaggtttttaaaatttttttattgaaagtatatgatttattgtataggatttatttataagttattttttgtgataaatttagaataggtaattttttataaggtttagaatttttagaaggaaaatagttttttaaaataaagaatattttttaaaaggtttttaaaagaattttttagtattttaagatataattgtaagtttattatttttgatttagattatgatataagttattatttagtaaattagtttgtagttaaaatgtttgtttaaatttttattgtatgtattatagatatttattagtgatttaaatgatatagttgtaaagaaagttatgattattatatgtttattagttattatgttttaaatttaaaagaaagttaagttaaatattttgtattttatgttgttaattatttagtaatattttttttatttttagagattttataaaagtttaatttgaatttttaaaattgtttagttattttaaaattataattaaatatagatatataattaaagtatattgggttaaattttagtatggaaaattattgaa

SEQ ID NO: 332 - DNA, 4256 bp, Artificial Sequence
  chemically treated genomic DNA (Homo sapiens)
atattttttaggtttatgatttgagagtttattaaataagagatggttatttttttggtttttaaattattttggaaataaagttatttttagagaggaattttaaaatattgtttgtagttatagtaattttaaaatttgagtgttgtatggtggaagtagataatttattttaggataattgttatttgttatattagtttgaggatggtggtgttaaagaggagttatttatttttaggtatattttatattaaatataaattgtataatttgtttaaattaaggaattatattaaattatattatggttattaaattttgttttgagaaagtgaaattgatttagtttttaaagagataaagagaaagtataagtaaattaaattgtagttataaaaagaaagataaaatgttgtagtatatttattgttttgtgtatttaatgaagttttttgttttggttataaaattagttttaaaggttttttttatattttatagtatgaaaaatttaaaaagtaatttatatgtaaatatttaaattatgatagaaatttaaagtaaaaagaaaatgaattaattgaattaaaatgtgtaggatgtttaaatttatttgataatatatttatttgataatatattaatatgaatttagtattttaaaatgttatataaataaatgtttttatattaaatattaatgtagttaggattttaagttaatattatttttttttttttatatgttttttttttgtttttattaaaaattgttaaaattatttattttttttttttttttttgtttttaaataaataaggttttttttaagatattgtaggattataaagttaaatttttgggtttaagttgttggtaaaattttagagatgttaagttatttatgtattaattatttttaaatttttttttaatttttttataaaataggagtagggagaggagaaatatttttgtttaaaaatgaggaattgaaaatttttattataaataaattatattaagtaagttaaagatagtaaaagagtaaaaatgttagtagatatttttaaaatggtaattatatattatttttggaatgattatatgaatgtggtttattattttttaagtttttatagtaaatatatatttatttgttttatttagttaaaaataaatataatatgtagttgtttttgaataattttttttttttttttttttttttttttttttttgataaagttttattttgttatttaggttggagtgaagtggttttattttgttgtttattataattttagttttttgggtttaagtgatttttttgttttaattttttgagtagttgggattataggtgtttgttattatttttggttattttttgtatttttagtagaggtgaggttttatttgttggttaggttggttttgaatttttgattttaggtgattttttttgttttgattttttaaagtgaagggattataaggtgtgaggtattgtgtttggttgtttttgaataattttgattaaaatttatatttgatatttattttaatatatattatagatttttattgataattttttttagtaagaaagataagttttatttaggtatttgtgaattggaggttaagtagttttagtatattttatatttttttaagattttttttttattttaaatgtttgtaaattttgtatttgataaagagtatatttttatttaatataaatatgtttttttttttagatttttttagtatttgagagatttgtatgtgtgtggttttttattttttttttttggttttttaagtttttagggtgttgttaggaggaggtttgtgattataaattttttttgaaaattttttaggaagttttttttttttttggagaattgaagtgttatttgattttaatttttttgtaaattttgttttttagagttgtttgttattttttgtttttgttgtagattttttatttatttggattggtttttgattgtaattatttggtgtgttgggtagtgtttttgtttttagtagtgtttgtattttttttatttgattttgggttgtggttgtggttagttagttagttgaaggttttatgttgttttttgttgttggttttatgttgttttttgttgtttgttgtttgttttttttttttttgtagttgttgagtgtatgtggtttgttttattttttggtgattagttagttttttttttttttttttttggtgttggtggaagagttttttttgattttgttttttaaattttttggagggattgtggtatttttttaggtaaggggatgttgtgagtgagtgtttggaggaggtgttattaattttgagtatttagtgaatgtggtatttttgaagttgttttaggttgggttttttttgggggtattagttggaagtagtttttgttagagttagtgttggtaaggaaggaggattgggtttttttttatttgttttttatattgttttttggtttttttgtttttagttgtgtttttttgtttgttagtaaaggtgtgtttgagtgtgtttattttgttaaaaagaaatttgtttttgttttgttttttttttttgtgatataatttttttaattgttaaattgaattggggtgtttggtgttatagggaaagtatggtttttttttttaattataagaaaaagtaaaattatttttttttagttgtgagagttttattgagaattgaaattatttgtatgattagaaagtgtttttttatttttttaatttttgatttttaggagtgtggggtttattaagttagaaattttagtttaaaggattttttttggagagttggattgtttttttttttttttttttttttttttttgtgtgtaaaatggttgtttggggtaagggttttttagatgtgtatattgtttggtataagagtagattttgaaaagatgaggtttatttaatatggatgggggagaattttgtttgtaggtagataggaaaatggggagggagttattggaaggatggattttatttttaaagttataatttttagattagaaaaagtgtttagtgttttagaagtagagttgtatagtgatttaaagattagttttaaatattgttttgttttttttatattttttatattttttttttttattgaaaatattttgtattttttgtaattataaagggggaagggaatatgagtgttttttgttttataggggttgttgtgagtttaaatgatgtattaatatatataagttttaagaatagtgttatatattttaagttaatatttgttagtttttgaattatttgttttgaggattggtttgtaattttgttttgaggtatagaaagaaaatgttttggagtaggatgtggtggtttatatttgtaattttagtattttgggaagttgaggtgggtagattatttgaggttaggagtttgaggttagtttggttaaaatggtgatattttgtttttattaaaaatataaaaattagttggttatggtggtgtatgtgtgtaattttagttatttaggaggttgaggtaggagaattgtttgaatttgggaggtagaggttgtagtaagttgagattgtgttattattttttagtttgggtgatagaatgagattttgatttaaaaaaaaaaaaaaaaatgttttggatagaattattattattatataaaaggaaagtttggatgtggtggtttatgtttataattttagtattttgggaggttgagataggtggattatttgaggttaggagtttgagataagtttgattaatatggtgaaattttgtttttattaaaaaatataaaattagtggggtttggtggtgtatgtttgtaattttagttatttggaggttgatgtaggagaattgtttgaatttaggagaaggtggaggttgtagtgagttgagattgtgttattgtattttagtttgggagataagagtgaaatttggttttaagaaaaaaagaaagaaagaaagaaagaaagattaagaagaatttattttttgaaaagattatgggtattttttattatttttatttataaagaaaagttaaatagtattaaagagtataataagtgtaaggaggtaaaagttttaattttttttgtgattattattttttaagtttattaaaaatatgtattatgtttta

SEQ ID NO: 333 - DNA, 4256 bp, Artificial Sequence
  chemically treated genomic DNA (Homo sapiens)
taaaatgtagtatatgtttttgataagtttaaaaagtagtagttataggaaaaattagaatttttatttttttgtgtttgttatattttttagtgttgtttaatttttttttgtaagtgagggtggtggagggtgtttataatttttttagggagtaagttttttttggttttttttttttttttttttttttttttttttgagattaagttttgtttttgttttttaggttggagtgtaatggtgtgattttggtttattgtaatttttgtttttttttgggtttaagtgatttttttatattagtttttgagtagttgggattataggtatgtgttattaagttttgttaattttgtattttttagtagagatagggttttgttatgttggttaggtttgttttgaatttttggttttaggtgatttgtttgttttggttttttagaatgttgggattatagatgtgagttattgtatttggattttttttttatgtaatagtgataattttatttaaagtatttttttttttttttttgagttggagttttattttgttatttaggttggagggtggtggtgtgattttggtttattgtaatttttgttttttgggtttaagtgatttttttgttttagttttttgagtagttggaattatatatgtgtgttattatggttagttaatttttgtatttttagtagagatggggtgttattattttggttaagttggttttgaatttttgattttaggtgatttgtttgttttggttttttaaagtgttgggattataggtgtgagttattgtgttttgttttaaagtattttttttttatgttttaaaataagattgtaagttagtttttaaagtggataatttaagagttaataggtattagtttaggatgtgtggtattgtttttaaggtttatatgtattaatatattatttaaatttataataatttttataaagtagggggtatttatatttttttttttttttataattatgaaaaatgtaaggtatttttagtaggaaagagaaatgtgagaagtgtgaaggagataggatagtatttgaagttggtttttggattattgtgtaattttgtttttagaatattgagtattttttttggtttaggaattatgattttgagaatggagtttgtttttttaatgattttttttttatttttttatttgtttataggtagaatttttttttgtttgtattaaataaattttatttttttagagtttgtttttatattaggtaatgtatatgtttgagaaatttttgttttagatagttgttttatatgtaggaggggaaggggaggggaaggagagagtagtttgattttttaaaaggaattttttgaattagggtttttgatttagtgaattttgtgtttttgaaaattaagggttgagggggtagggggatattttttagttgtataggtgattttgatttttggtggggtttttataattaggaaagaatagttttgtttttttttatgattaaaagaagaagttatattttttttatgatattaaatattttgatttaatttggtagttaggaaggttgtattgtggaggaaggaaatggggtgggggtggatttttttttaatagagtgaatgtatttaaatatgtttttgttggtaggtgggggagtgtggttgggagtagggaggttggagggtggtgtggggggtaggtggggaggagtttagttttttttttttgttaatgttggttttggtgagggttgtttttggttggtgtttttgggggagatttaatttggggtgattttaggggtgttatatttgttaagtgtttggagttaatagtattttttttgagtatttgtttatggtgtttttttgtttggaaagatattgtggtttttttagaggatttgagggatagggttggagggggtttttttgttagtattggaggaagaaagaggaggggttggttggttattagagggtggggtggattgtgtgtgtttggtggttgtggagagggggagagtaggtagtgggtggtggggagtagtatggagttggtggtggggagtagtatggagtttttggttgattggttggttatggttgtggtttggggttgggtagaggaggtgtgggtgttgttggaggtgggggtgttgtttaatgtattgaatagttatggttggaggttgatttaggtgggtagagggtttgtagtgggagtaggggatggtgggtgattttggaggatgaagtttgtaggggaattggaattaggtagtgttttgattttttggaaaaaggggaggttttttggggagtttttagaaggggtttgtaattatagatttttttttggtgatgttttgggggtttgggaagttaaggaagaggaatgaggagttatgtgtgtatagattttttgaatgttgagaagatttgaaggggggaatatatttgtattagatggaagtatgttttttattagatataaaatttatgaatgtttgggataaaaagggagttttaaagaaatgtaagatgtgttgggattatttagtttttaatttatagatatttggatggagtttattttttttattaggagggattattagtggaaatttgtggtgtatgttggaataaatattgaatataaattttgattgaaattatttagaagtggttgggtgtggtgttttatgttttgtaatttttttattttgggagattaaggtggggggaattatttgaggttgggagtttgagattagtttggttaataggtgaaattttgtttttattaaaaatataaaaagtagttgggggtggtggtaggtgtttgtaattttagttatttgggaggttgaggtaggagaattgtttgaatttgggaggttgaggttgtagtgaatagtgagatggagttattttattttagtttgggtgatagagtgagattttgttgaaagaaagaaagagagaaagagagagagaaaaattatttagaagtaattatatattgtgtttatttttaattgagtagggtaaataaatatatgtttgttgtaggaatttaggaaataatgagttatatttatgtgattattttagaggtaatatgtagttattattttgggaatatttgttaatatttttgtttttttattatttttagtttatttgatatagtttatttgtgataagagtttttaattttttatttttgaatagaggtgttttttttttttttatttttgttttgtgagggagttaggggaggatttaaaagtaattaatatatgggtaatttagtatttttaaaattttgttaatagtttgaatttgggagtttggttttgtagttttataatattttagaagagattttatttgtttaaaaataaaaaggaaaaagaaaagtggatagttttgataatttttaatggagatgggagaagaatatgtagaaaaggggaaatgatgttggtttagaattttaattatattggtgtttaatataggaatatttatttatataatattttaaagtattaaatttatattagtatattattaaatggatatattattaaatgggtttaagtattttatatattttaatttaattgatttattttttttttgttttggatttttattatgatttaaatatttatatatgggttattttttagattttttatattatgaaatataagaaaaatttttaaggttagttttatgattaagatgaaggattttattgaatatataaaataataaatatattgtaatattttgtttttttttttgtagttgtaatttggtttgtttatattttttttttgtttttttgaaaattgagttagttttatttttttaggataggatttaataattataatataatttagtataattttttgatttaggtaaattatgtaatttgtgtttagtatgaaatgtatttaaaaataagtaatttttttttaatattattatttttaaattaatataataaataatagttattttaaaataaattgtttatttttattatgtagtatttaaattttaaggttgttatgattgtagatagtattttaaaatttttttttggaaatggttttgtttttaagatgatttaggaattaaagaggtgattattttttgtttaatgaatttttaaattataaatttgggaagtgt

SEQ ID NO: 334 - DNA, 4414 bp, Artificial Sequence
  chemically treated genomic DNA (Homo sapiens)
aatgtttggagtatatattttaatgaatatttattttattttatttttttttatttttgaattaagtaattttgaatttaaagttgttatgattagtattgaaaagattattggattattaattgtgtgattttgggatagtaattttttgtattttagtttgtttatatgttatatatgaaggttgaagtttgattttgttttgtgattattattttaaatatttgatgaaattaaattttagtgtttggaatggtagtataataaatttattaagaataaataatttattgtaaaaatatattgatttttaaatgatgtaattgatagttatattattgtagagggttgataaataataaaagaaatgaaagatgtatatggtgagaattgaaattattttgataagttttttatttgtttattatttaaaattaatgattatgttgaatgtttataaattataaaatataaaagaaattttataaatgtgtatgtataggagtttaagttattaaaagttttaaagtataagtttaaattaaattaattaaagaagttgagaggaaaaattggtttttatttttaattattattgttttgaggttttatgtttaatataattttttaagtagaggttttagagagaagagttgtgaggatatttttatatttgtgtagaaggaaaagtttgttatttattttagtatttttagtgttatattgatgtgtattttggatttattttgtttttattgtataaatttatatttgattttaaagaaaaggaaaatttaaagttttttttttttaaggggatagaaattttttgtgttaattgtttgatttttttttttgtaaggttttattggaaattttttgtaatataatgtaggggatttttttatgtgttgatgttgtttatatagtggggtgggtttgattgaagaaaaaaaattgtatatatgtatgaaagattatggttttatttttggaaagtatgaaaggtgattgatatttttaagaagtttttgttatttaggaaaattattaaatattttatttagagatatttggaaagattgaaggaaaggaagaatgaagaaagtagaatttagatttatgtggggagagatttgtggtagaggaaaagtattttttttgaatttgataagggatttgtttgggggaattttttgtttagttttttattattagggttttttgaagttgggttttttattgggtagttttttgggagtgtagtggggaatttttatattttttttttaggtttttgaaggattttgtttttttagtgttttttttaggttggtaggagttttgagtttgatatttttttttgatgggataggtaagttttgtgggtgtgtaaatatgttgtaattaagttttttgttgattttatagttttgtgtgtttttgagaagaagtgattgtatttaattgtttattgttggtttgttttttaagagtttgggggttttttttttttaatttagaattagttgtatggggggtggggaaatgggggtggggaaggagtgggagggtagtggtttttgtgagtagagtgatgttattgagtgagtttttgaatggggagtgttgttgtttttaagttgattggtattttttgttaggaagaaatgttaagaggtgggagtgtttggggagggaggtaggtggtttttattgtaggtgtggggagttgtttttttgtttttttgtttgttttttaagtttggatttttaggagtggttgaagttgtggagtgtttttggagtttgtgaatgaatttttttttttttttttttttttttttttgttgagttttttttttggttttgatggtatagtgatataatgatgatgggtgttataatttgtatttgaatttgtaggtgagttgttttgagtttttttggggaagaattttaggtgtgtggatgtaatagttgagaatattaggtgttgtggataggagttgggattaagatttttggttagttttgtatttttttgtattttttagtattgttttgtattttttgtatttttttttgggttattatgttttttatgtgatttgtttgggtaatgttgaatttagttgtgtagtgttgtagtgaattttttttttaaattgtaataagttgttttttaaggtaattatgttttttttgttttttttttaaaaaataaaaataaaaaatttatagaaaaaaatttgtgagtttagaaaaaagaagtaattggtagaaggttttaattaaggtaaagagttgtaaggtgaagttaagaaaatgtaggtatttaaaaaatgtaggtaatttttataagggtttttggggagaggtatatagagggattttggtgttgaaaaagatttagataaaagaaatttagggtggggtggggggtaaaatgattaatggaattgggggaagggagggaataaattgtaaagaaattatagaaaagtggtgggtttttgagttggagagaagagagggatttttggtattttgatttttttgttgttgttgtttttaatatgtttgaggtaaaagtttgaatggggattattaagatttgttatagataagtttttgaagttgttttggtgtaggttatttggttttttagtttttggtgtgtggttagtgtttggtgtttttggaaagttatttttgggtagtttttgatagtgtgatttggtgtttaagtagtttgggattttgtgtggatttgatttttttagattgtaggtagtttgggaggaggtttggttgggggaggtgtaggatttttgttgtgtttttttgatgatttggggattgttatggtttttttttggtgtttttgggtttttttgttttgtatgtggtgtgaaggggttagtagggaaggagtagaggatggggggtggggttgttggagttttgtggaggtttgggaggtttttgggtgggaaaagtttgttttgaattggtagggatgtgtaataattttttttattttgaagagtgaaatagggtttgttgtttttattttaataagtaaattggtatttagagtgtattgtagataaaggtggtttggggatttgaattaggggtttttgggttagtttttttgtttagattataggagttttttgtttttttatatattttttatttttttttagttttttgttttagttgagtaattttattggtaggtttagtggtagtggtgtgtgtgtgtgttgggagttttgggggatgtttttggttggagtgttttattgttttgtagaggtgtgggtgttgtagggtgatatttttggtgtgtgtagatttagggtatttgggttgttttggtttgtggtttgtgttattgggtgtggagtggtttgggtgttaggtagaggagagtggggtagaaaaatagtgttatagtttaaattatttgttttttaatttaattgtgttttggtaagttttgtatgtttttgggagatgttgtgggaagggggagaaatttatatggtgtttggagagttgttttgttgtgtgtatatttgtggtagagtttttttgggttgtgttttttatttttgtgtttttttttgtttttattttttttgttttttttttttttttttagtttttgttttttttttttagtttttgtgtttttttttttatagttgataaatgaatggttagtgtgaaatttttgttttttttgtgttttaaggtagtagggagggaggagtgagggaggtggtgtgtttttttggatttgtttttagtttagtttataagatttgtagaatttagatgtttaggaattgggagttttgtggtgggtgtgggtgttttttgatggagaagttttgtataggtggagaaaaataagttttttagattaagtgagtattttttataattttgtgtttaaggatggaaggttttagtttttttttaagttatttattttgtattttataatttgtggtgtatatttaggagtttggaggattttgaaaaaaggttttggtttgtgtaaagtgtagagatgtttttttgtgagttggttggaatgtatgtggtgttttgggtttagtttgttgtttagtggatgaatgtatatggttagggtggagttaggttttggaggtttagatgtgttattttgggtgtttttaagaaagataatatatatattgtgtttttaaaatttatgattatttgaatttaatgttagggttttgttttaggatattgtaaaagaagggtttttaatttaaaatttaaatttttttaattttagggtgggtgttggatgggaaagtggagagaaggtgggtagtgggaggaaaaaagaaagggaaggaaggga

SEQ ID NO: 335 - DNA, 4414 bp, Artificial Sequence
  chemically treated genomic DNA (Homo sapiens)
tttttttttttttttttttttttttttttattgtttgttttttttttatttttttgtttgatgtttgttttgaagttgaggaagtttaagttttggattaggagttttttttttgtaatattttggggtggggttttagtgttgggtttaagtggttatgggttttgagagtatggtatgtgtattattttttttaaagatgtttagggtggtgtgtttagatttttgaaatttggttttattttggttatgtgtgtttgtttattaagtggtgaattggatttagggtgttgtgtgtgttttagttgatttgtgagaaggtatttttgtattttgtatagattaagatttttttttagggttttttaaatttttagatgtatgttgtagattgtggagtgtaaaatgaatgatttaagggaaaattagggttttttatttttgaatataaggttgtgaaagatgtttgtttggtttggggggtttgtttttttttgtttgtgtgggatttttttattagggggtgtttatatttgttgtaaaatttttaatttttagatatttaggttttgtaagttttgtgagttgaattgggggtagatttgaaggagtgtattgttttttttgtttttttttttttgttgttttggagtatgggaaaggtagggattttatattagttatttatttgttagttgtgggggaggggatgtagaagttagagagagagaatagaggttgggagaggggaagggaggtagagaagatggagatagagggagatataaagatgaggaatgtgatttagagagattttgttgtgggtgtgtgtgtggtaggataattttttaggtgttgtgtagatttttttttttttttgtagtattttttagggatatgtaggatttgttgagatgtagttggattggagagtaaatagtttaggttatgatattatttttttattttgtttttttttgtttaatatttagattgttttatgtttagtgatatagattgtgggttagaataatttggatgttttaggtttgtatgtattagggatgttgttttatagtgtttatgtttttgtaggatggtggggtgttttagttgaggatgttttttggggtttttggtatatgtgtgtgttgttgttgttagatttgttagtaaagttgtttaattagagtggagaattaggagagggtggggaatatgtaaggaaatggaggatttttgtagtttgggtgagaggattgatttagaggtttttgatttgggtttttgagttatttttgtttgtagtgtgttttgggtgttggtttgtttgttgagatgggagtgatagattttattttattttttagggtgagaaaaattgttgtatatttttgttgatttagaataggttttttttgtttaggggttttttagatttttgtggggttttaataattttattttttattttttgttttttttttgttggtttttttgtattgtgtgtaggataaaagaatttaggggtgttgggagagaattgtgatagtttttaagttgttaaagagatatggtggggattttgtattttttttggttggatttttttttagattgtttgtggtttgaaggggttaggtttgtgtaaggttttaggttgtttgggtgttgggttgtattgttaggagttgtttgggagtggttttttaggaatattaggtattgattatatattaggggttgggaaattaggtggtttgtattaaggtggttttggggatttgtttgtggtaagttttggtagtttttatttaaatttttgttttgagtgtgttaagaataataataataaaaaaattaaagtgttaaaggttttttttttttttttagtttaagaatttattatttttttatgatttttttataatttattttttttttttttttaattttgttagttattttattttttattttattttgggttttttttgtttgaattttttttaatattaaggtttttttgtatgtttttttttaaaagtttttatgaaagttatttgtattttttaagtgtttatatttttttaattttgttttatagttttttgttttaattaaagttttttattaattgttttttttttttaagtttgtgggtttttttttataagttttttgtttttgttttttaaggggggaataaaagaaatgtgattattttggaaggtggtttattgtagtttggggggaaaatttattgtagtgttgtgtgattgggtttggtgttgtttaggtgggttatataggaagtgtggtggtttggggaaggatgtggagggtgtgggatggtgttggaagatgtgggaggatgtggggttggttgaagattttggttttagtttttgtttataatatttaatgtttttggttgttgtgtttgtatgtttggagtttttttttagaaaggtttggggtagtttgtttgtaagtttaaatgtgggttgtgatatttattattattatattattgtattgttagagttgaggaggagatttagtgagaagaaggaggagggagaggaggagggtttatttataggttttaaaagtgttttgtagttttagttatttttaagagtttaggtttggaaagtaggtggaggggtggaaaggtagttttttgtgtttgtggtagggattgtttgtttttttttttaggtatttttattttttggtgtttttttttgataagaagtattaattggtttggggatagtagtgttttttatttagggatttatttagtaatattgttttgtttgtggaaattattgtttttttattttttttttatttttatttttttgttttttgtgtagttagttttgggttaggggaaaggagtttttaggtttttagggggtaggttagtaatagataattgagtatgattatttttttttgggagtatataaaattgtaaaattagtaaagaatttggttatagtgtgtttatgtgtttatagagtttgtttgttttattaaagggaagtgttaggtttaaggtttttgttaatttgaaagagatattgagaaaatgagattttttggggatttagagggaaagtgtaagaattttttattgtatttttagggaattgtttaatggggagtttggttttaaaagattttggtaataaaaggttggataggaaatttttttaggtaaattttttgttggatttaaagagaatattttttttttgttataaatttttttttatataagtttagattttgttttttttgtttttttttttttttagtttttttaagtatttttgagtagaatatttgataatttttttgagtaatagggattttttggaagtattaattattttttatgttttttggaaataagattataattttttatgtgtatatgtgattttttttttttagttaggtttattttattgtgtaaatagtattaatatatggaagagttttttgtattgtgttataaaagatttttaataggattttatagagaaaagggttaaatagttgatataaaggatttttgtttttttagaaaagagggattttggattttttttttttttgaagttaagtatgagtttatataataggaataaaataaatttaaggtgtatattagtataatattagggatattagaatggatggtaaatttttttttttatataaatatgaaagtatttttataatttttttttttgaagtttttatttagaaaattatattaaatataggattttaaaatagtagtgattaaagatgaaagttaatttttttttttaatttttttgattagtttggtttaaatttatgttttaaaatttttagtaatttagatttttgtatatgtgtatttataagattttttttatattttgtaatttgtaggtatttagtatggttattgattttaagtgataaataggtagaagatttgttaggataattttagtttttattatgtgtattttttattttttttgttatttattagttttttgtagtaatataattgttagttatattatttggaaattaatgtgtttttgtagtgaattatttatttttagtaaatttattgtattattattttaaatattgaaatttgattttattagatgtttagaatgatagttatagagtagaattagattttaatttttatgtataatatgtaaataaattaaggtgtagaaagttattgttttaaagttatataattaatagtttagtggtttttttagtgttaattatagtaattttagatttaagattgtttgatttaggaatggagagaaataaaataaaatgaatgtttattgaaatatatattttagatatt

SEQ ID NO: 336 - DNA, 4001 bp, Artificial Sequence
  chemically treated genomic DNA (Homo sapiens)
ttgatatggaatagagttaagatttttttttttttttttgatatggagttttattttgttttttaggttggagtgtagaggtgtaattttagtttattgtaagttttgttttttaggtttatgttatttttttgttttagttttttgagtagttgggattataggtatttgttattatatttggttaattttttgtatttttagtagagatagggttttattgtgttagttaggatggttttgattttttgattttgtgatttgtttgttttggttttttaaagtgttggaattataggtgtgagttattgtgattggttagatttaagatttgaatttaggtttttttggttttagaggtttttgttttttaattttttaggatggtatagtaatttgttttataagaggtgtttgttttaagtgtgtttagtatatggaagtaagtttagaaatgtaagtgtatatttgtaaagaggtgtgggagatgggggggagggaagagagaaagagatgttggtgttttttattttttagtttttgataggtgtttttgatttttttttgattagtatagttgtatttttggttggggtattttaattagaattgttaaatttagtatataaaaataaggaggtttagttaaatttgaattttagataaataatgaataatttgttagtataaatatgttttatgtaatattttgttgaaattaaaaaaaaaaaaaaaagttttttttttatttttatttttattattaggtttaaggaatagggttaggggttttaaatagaatgtggttgagaagtggaattaagtaggttaatagaaggtaaggggtaaagaagaaattttgaatgtattgggtgttgggtgtttttttaaataagtaagaagggtgtattttgaagaattgagatagaagtttttttgggttgggtgtagttgtttgtggttgtaattttagtattttgggaggttgaggtgggaggattatttgaggttgggagtttaagattagttttattaatgtggagaaattttgtttttattaaaaatataaaaaattagttggttatggtggtatatgtttgtaattttagttgtttgggaggttgaggtaggagaattatttgaattagggaggtagaggttgtggtgagtagagattgtgttattgttttttagtttgggtaataagagtaaaagtttgtttaaaaaaaaaaaaaagtttttttgatgtgattgtttttttttaaatttgtagatttttttaagattatgttttttagatattttaaagattttagaagatatgttttgggggttttggaagttataaggtaaatataatatatttttttttttgattattaattttattagaggatgtggtgggaaaattattatttgatattaaaataaataggtttgggatggagtaggatgtaagttttttaggaaagtttaagataaaatttgagatttaaaagggtgttaagagtggtagtttagggaatttattttggattttgggggagggggtagagttattagtttttgtatttagggattttttgaggaaaagtgtgagaatggttgtaggtaatttaggtgttttggtgttaggagggatgtatttaggtttgtgtgaagagagggagaaagtgaagttgggagttgttatttttagatttgttggaatgtagttggagggggtgagttgggagtgtgtttgtttttaattataggagaaggaggaggtggaggaggagggttgtttgaggaagtataagaatgaagttgtgaagttgagatttttttttattgggattggagaaattaggggagttttttgggtagttgtgtgtttttttttatggggttttttattgtgttgtgtgtttggtttttattttttgtagtattttgtgttttgtgtttttttagttgggtttagttggagttatggggttggagttgtagtgagtattatggagttggtggttttgtgttgttgggggtttttttttgtttttttgttttttggagttgtgagtatttaaggtgggtttggtgtggggaggggatggagtagtggtgggattttgttttgtggatgttttgttgaggttttgtggttggtggggttagaggggtttggatgagtttttttattttgaagttgtggatagttgagatgtttagggtagttgggttttggggtttttgggtgggagggggtagttatatggtagtggtttgagatggtttatttaagagattggtgttttttaggttttgaggggttttgggaatttgttaaagaagttttttgaaattgtttagaaagtttttttgtaaagggtgtattgtgtagagtgtgtgtgtgtgttttttttttttttgagtttttttaagtttttttaaagtttttttagttggtagtttttgtttttggattggtttgggttggattttttgggggggttttttgttttgttttttttttagtttttttttgtttttttttagatgattttggtttggttgtttttgtttttggtggggttgggtgtgtgtgtgtgtggtggagtggagggtggtatagtaatttgttttaattagagttggggaggaaagggtggtttggagggtggttttttgttggggtttgggttgggggtgggggagatgtttgttttgaatagatttttggggttagtttagggattgtgttttgtgatttttggagtgtgtggattatggaggggtgggggtgggttttttggggtgtaaagtgggagagtttttagagaaggaagttaagaaataaggttagatgggagtttagggagggttgtgttgttttgttgttttttttttggtgttgtgtgtggggaagggtgagtgggggtagtgtgtattttgatttatttgtttatttgtgtgtattaattataaaagttaatatatagtttgggttaggtatattttgttaggaattgtttgtggtgttttgtatgtatttttttttaattttagaatatttttatagtggaagttttgttagtattttggattgagtagtagtttagaggttgagtagtagttagtaagtggtggggttaagatgggattttaggtagtgtgatttttaattatgtatttgaaattgttatatggatgagtgtatttggagtaatgagggatattgttttttgagttattgggttgtaggggagataaaatgaaagtgttttgggagttgtgggtggtttttataggttagagggtttggggagggagtgggtgttattgtggttgtgtgttgtttgaggggttttttgtgagtgagtgtatggttgtgttatttttgtaggtttatgttagggtgttttttagttgtgtggtttttgtatttgtgtgtttgggttttgtgttgttaaatagtagtttttttgttgatttggggatataggttgaattttgttttttgtaggaatttttttaaggtgttgggttagatttgttataaatagagggaggtagttttttatggttatgtttttttgttgaggaagaaggttttttttttttagggagtatatttttgttttttttgttttttagataagtatttttattttttattttttgatgagaagggtgaggttatattgagttgttaggttgagttgttgtttttttttattttgggttgggagttgattagggaatggtagttgttgtagagttggatttgagggttgggttttttggatggggtttttttatgtttttattttttaatttgtattattgattgtgttgtgtaggagttagttaaaaagttattgtatagtttgggtaataaggtaaaattttgtataaaaaatataaaaattagttggatgtgattatatgtgtttgtagttttagttattttggaggttgaggtaggaggattatttgagtttaggaagttgaggttt

SEQ ID NO: 337 - DNA, 4001 bp, Artificial Sequence
  chemically treated genomic DNA (Homo sapiens)
aagttttaattttttgggtttaggtgatttttttgttttagtttttggagtagttgggattataggtatgtgtaattatatttaattaatttttgtattttttgtatagagttttgttttgttgtttaggttgtgtaatgattttttaattaatttttgtataatataattaatagtgtaggttgaggggtgaggatatgaggaggttttatttagagaatttagtttttaaatttagttttgtagtaattgttattttttgattaatttttagtttaaggtgaggaagggtagtagtttagtttgatagtttagtatggttttattttttttattagaagatgagaggtgaagatgtttgtttgggaaatagggagggtaaggatgtattttttggaagagaggaatttttttttttagtaagaaggtgtggttatagaaggttatttttttttgtttatggtagatttggtttagtattttaagggagtttttgtagaggatagagtttagtttgtgtttttaagttagtagagagattgttgtttggtaatataaagtttagatatataaatataaagattatataattgaggaatattttggtgtagatttgtagagataatatggttatgtatttatttatagagggttttttgggtaatatatagttatgatgatatttattttttttttagattttttgatttatggagattatttatgatttttagaatatttttattttgttttttttgtagtttagtgatttagggagtagtgttttttattgttttaggtgtatttatttatatagtgattttgaatgtatggttgggggttgtattgtttggggttttattttgattttattatttattagttgttatttaatttttggattgttatttagtttagaatgttggtagaatttttattataggggtgttttaggattaaaggagaatgtatgtaaaatattataaatagtttttggtagagtatatttggtttaggttatatgttagtttttatgattaatgtatataggtggatagatgggttaggatatatattgtttttatttatttttttttatgtatagtattaaggaaaaggtagtagaataatgtagttttttttaggtttttatttggttttattttttagtttttttttttgggaatttttttattttatattttaagaaatttatttttatttttttatggtttatgtgttttaaaagttatagagtatagtttttaagttggttttaagaatttgtttaaagtaaatgttttttttgtttttaatttagattttagtaagaggttattttttgggttatttttttttttttggttttggttgggataggttgttatgttattttttattttattatatatatatatatttgattttgttagaagtaggagtaattaaattaaaattgtttgaaggggagtggggaggggttggaggaggggtagggtagaggatttttttaaggaatttagtttaggttagtttggaggtggaggttgttaattggaaaggttttgagaaagtttgagggggtttaagaaggggggaaatgtgtgtgtgtgttttatgtaatatattttttgtgggaaaattttttgaataattttagagaatttttttgataagtttttggagttttttggagtttggaaagtgttagttttttggatgggttattttgagttgttgttgtgtaattgtttttttttgtttgagggttttagggtttggttgttttgagtgttttgattgtttataattttgggataggagagtttgtttgggtttttttggttttgttggttgtgggattttggtggggtatttatagggtagggttttgttgttgttttgttttttttttatattagatttattttgggtgtttgtggttttggggggtaagagggtgaggaggagtttttagtggtataaggttgttagttttatggtgtttattgtggttttggttttatggttttggttggatttggttgggagggtgtggggtgtggggtgttgtgaggggtgggggttgggtgtgtggtgtagtaaagggttttgtgggaaggggtgtgtggttgtttggggggtttttttggtttttttggttttaatggaggggaattttagttttataattttatttttatatttttttaagtagttttttttttttatttttttttttttttgtgattgggagtaagtgtgtttttagtttgttttttttaattgtattttaataagtttgggagtggtaatttttagttttattttttttttttttttgtgtaggtttgggtgtgttttttttagtgttgggatgtttgggttgtttgtagttgtttttatatttttttttggagaatttttaaatgtagaggttggtgattttgtttttttttttggagtttgggataaattttttaggttgttatttttaatatttttttaagttttaggttttattttaaatttttttggggagtttgtattttattttattttaagtttatttgttttaatattaaataatggtttttttattatattttttagtaaaattgatagttaaggagggggatgtgttgtgtttattttgtggtttttaggatttttggggtatattttttggaatttttgaagtatttgaaaagtatgattttaagagggtttataaatttgggaggagatagttatattgaaaggatttttttttttttttaaatgaatttttgtttttgttgtttaggttggagagtaatggtgtgatttttgtttattataatttttgtttttttggtttaagtgatttttttgttttagttttttgagtagttgggattataggtatgtgttattatgattagttaattttttgtatttttagtaaagatagggtttttttatgttggtgaggttggttttgaatttttaattttaggtgatttttttgttttagttttttaaagtgttggaattataattatgagtaattgtatttagtttaaaaagatttttattttaattttttaaaatgtattttttttgtttatttaaggaggtatttagtatttaatgtatttaaggttttttttttgttttttgttttttattagtttgtttaattttattttttaattatattttatttggagtttttgattttattttttaggtttagtggtaggggtggggatggaaggaagatttttttttttttttttaattttaataagatattgtatgggatatatttatattaataaattatttattgtttatttgaaatttaaatttaattgggtttttttatttttatgtgttaaatttggtagttttagttggaatgttttagttaagaatgtagttatattggttaagaagggattaaaggtatttattagggattggagaatgaaggatattagtatttttttttttttttttttttttttattttttatatttttttataggtatatatttgtatttttaaatttgtttttatgtgttgagtatatttaaagtaggtattttttgtgggataggttgttatgttattttagggagttgagaaataggggtttttgggattaagaggatttgggtttaaattttgaatttggttagttgtggtggtttatatttgtaattttagtattttgggaggttgaggtaggtagattatgaggttaggagattgagattattttggttaatatggtgaaattttgtttttgttaaaaatataaaaaattagttaggtgtggtggtgggtgtttgtagttttagttatttaggaggttgaggtaggagaatggtgtgaatttgggaggtagagtttgtagtgagttgagattgtgtttttgtattttagtttgggagatagagtgagattttgtgttaaaaaaaaaaaaaaaaattttgattttattttatattag

SEQ ID NO: 338 - DNA, 4334 bp, Artificial Sequence
  chemically treated genomic DNA (Homo sapiens)
aaattaattatgaaaaaaattattaaaatttattaaataaatattgggaaatatgatttgaatatgatattggttttagaaaattaagttaattgagtttttttggttataaaatttttggatttttaaaattagataaagttataagggtgaagaattttttttttataaattttttaatattttattgaaattgtaagaagatattttagatttaatttaatagtgtttttggagttattttaatattgtttataatttattgtgtaaatgaaatatttatttttgttttgtttgtgtttgatgtggtggataagaaaatgtttaagttaatagtaattaataatgttgaatttttattgttttttaggtttaagtttttttgtttaatagtaagtaaaatgtttatgaatttttagattttgatttatatttgttgttgttatgttatgaaaaatgttgtattttttgttgatttttttaatattatgatttttgtagatgttagttagtattaaaaatgtaggatgataggtttttaaaagttaggaattaaaattagaggtagtgataagatttaagaaaagtagagaattagatgtagtattggatttaggatgggtgtggttttggtttgggtgaggaaaagaggattggttgtttttggttaattagagtatgttttgtgttttggtttttggttttgttttttttttttttgtgtttttttgaatttttttgaatttaatattttggagtttgtgtgtgtgggaaggggaggggtgggtggggttaatggtttaatttgggtaattttgtttttgtttgattttttttgtgtggatgttttttttaatttttgttaaaaatatttttaggttgttgttattattttttttatagtttagtgggtggggtaggttttgggaataggtttttgggtggttttgtggtgagtttgttattgttttttgttgtttttatgtttaatttgttgttatttatgttgtttgtgtgtttggttgtgaagatagaagaatttttgtggggtttgggagtgttgttttttaattattagttgtggttgttaggggatggttgtagggagggttgtggttttggttgtttgtagtttggttttaaagttgttggtttttggggtattgttttgtttttttagataatggggaatttggtggggtttgtagggaagggagggagggagggaggtaaatgagggtttatgttttttattgtttttttgatggtattttggagtggatgtttggtgattgtttagttttttgtttatgaatagttgtgtttttggagagtggggataaaggtgaggttttgtttgagttatatataaagtggagtgatttttgtttattaatttttttgaggtttgtagttttgtttgttgttttgtagtagggggttgttgttatggtttagttttttttgttgattgtgttttttttgttggttttagttagttgttgttttttttgagttttgtatttatttgtttagtttgagttgtttgattatattttgagtattaatagatttgggtgtgtataaaagtgttaaatagaggtatgtgatttttgtgtggggttttgtattggttgagagtggtggtatgtgttgtttttgttttttataatttgtgtggagtgttgttttttgggattttgaagtattttgggaagtgtagttttgttttggagggtaggaggataatgttgggggttgtagggtgtttggggagtatttttaggtgtgggtttgggattaggggggtggttttgttgtggaagagggtgtggtagtggattttggattaggtttgaattagttttttatttttgagaataagggtagggtggagtaggtggagggtgggggggtttttttttatttttttaaattttggttgtttggattttattttgtagagttatatgtttgttttgttttaagggtagtatttggatagagtagtgttttttttagtgtgttatttatatgggtgtttaagatgtttgagtttttgtgatagtataatgttattttatgtttttgtagggttttttgtttttggtattttatattgatattggtgtgttatttatattgtgatattattgtaatttttaatttatttagtttataggttgtgggtgtggttttttttttattgtgtgtgtttttgttagtatttttaggtttttgagttggtgattagggatttgtgtgggaaagtgtggggttttggaatttgattgtttttggtttaataaagttatttagtttaaatgtagattttatttgtttttttaagttttttgtggatgataggggaggaagagtaatagttgttttagattatatagattgtagttaagtgttgtttttgtttttagagtatgtgttttttagagtagtattgggttttttttaaaaattgaaaaaggagttataaggttattgttttttttgatttggatagtttagaattttagtaaaggtataaaggaaattggtttgattgtgttttagaataattggtttttttttttataaaaaggggaaaaaaataaatgaaatgaatatggtttttgtttttttttattttttgattaagattgtgtttttggttggtggttaatatattaagatatttgttttgagattttgattaagtagaagagatatttttattttattaatgagttgtatttttttaaattaagaaataaatgtgattaatttttttgaaataatagttttaatttagaaagatttttatgtttagttagttattagggatgtgttagagataaaatataattaaggggtgtttaagataataaaaattggattatataagtagtagtatattatataaagtaaataattagtaatgtgttgttgtttgaaatatgtttgttgtggtattttttttaataattgtttttgtgtggggttggttttttttttaagttaattgaagtggtttttatttagtttgtgagtaggattaggaataatttagatattgagttttgaaaggtttttttttagattaaatttagttttaaaatggttaggtgtttttgtttgttatttttttgaatagaattttagatattattagaaaagttggagaaggatgggtatgagattttttaggaaagtgatagataggtaggtaatataaatgagtaaggaatttaagtttaagaggtttttatttattgaataggttttttattttgaagtttttgtatttgatttggaggtttatagaggaaggttttatttatttaatgtatttttttaagtataataaattgttatataaaagttttatatttttgattattaatgttgtgatagaaaaaagaaataaattttttaaaatattgataatttgaaagtatttatattgtttttttttatattttttttttttttagagtagatgtttatttttatggaaattatagtaaggaatgtagatgttagaatttatgtttatttttaattttttttagtaatgttatttggtttttgggtttgttgggagatgtttggttttgttagtttgtgataatgttttaagttttttatagttgtttgaggattgagagggttgggttaaagttttttttagaatgagtttttgaataaaaaggtgtttttgaggtgggatttttgtttttttattattattattattattattattattattattattattattattatttgatttaaaaaaaattgagatagggttttattatgttgtttaggttggttttgaatttttgggtttaagtaatttttttgttttagttttttaaagtgttgggattataggtatgagttattatatttagtttgatttttgttttttagggtggggttgtttttttaagagttagattatagtttattattgttagtttttgtgggtgttttatataagttttggaataggaagggtttttaattgtaaggagagataatagttttgttattttattttggagaggggtagaattgttttttttgaaagttttttaaaatgaattttaagatttatttttttttgaagtggtagtaaggagttaatgtttatattttggaattgtttatttttgtttataagaattatttttgtttttgtttagatggtttggttggattgttatggagttggttgtgattatggagttatataatgaagtggagatagggtagttatttagtttatttgatttgtgtagatagttaaaggagagtattttaggttttaa

SEQ ID NO: 339 - DNA, 4334 bp, Artificial Sequence
  chemically treated genomic DNA (Homo sapiens)
ttgaagtttgaagtgtttttttttagttgtttatatagattaaataagttggatgattgttttatttttattttgttgtgtggttttatagttatagttagttttataataatttaattaaattatttgagtagaagtaaaaataatttttatgggtaaagatagatagttttaagatgtgaatattaattttttgttgttattttagaagagagtggattttgaagtttgttttaggaagtttttgagaagggtgattttgtttttttttaaggtgaagtggtaaaattgttgtttttttttatagttgaaagttttttttattttaaggtttatataggatatttataaaagttgataataatgagttgtgatttggtttttgggaaggtagttttattttaaagaataaggattagattgggtgtggtggtttatgtttgtaattttagtattttgggaggttgagataagaggattgtttgaatttaggagtttgaggttaatttgggtaatatagtgagattttgttttaattttttttaagttaaataataataataataataataataataataataataataataataataaaaggataggaattttattttaaaagtatttttttatttaaaggtttattttaggggaaattttaatttagtttttttagtttttaagtagttgtgaggagtttggaatattgttatagattggtagaattaggtattttttaataaatttagaagttaagtggtattgttaaaaaagattaaaaatgaatatgagttttaatatttatgttttttgttatggtttttatggaaatagatatttgttttagggagaaagaaaatgtggggggaagtagtgtaagtgtttttaaattattagtgttttgaaagatttattttttttttttgttataatattaatagttaggaatgtgagatttttgtgtggtaatttattgtatttaaaaaaatgtattaaatgagtgggatttttttttgtgaatttttagattaaatataaagattttaagataaaaagtttgtttagtgggtaaggattttttgggtttgggttttttgtttatttgtgttgtttgtttatttgttgtttttttgaggggttttatgtttatttttttttaatttttttaatgatgtttgagattttgtttagaaaaatgatagatggaagtatttagttattttgaagttaagtttggtttgagaagaagttttttaaggtttagtatttgaattatttttggttttgtttataggttaagtgaaaattattttgattggtttgggggggaggttgattttatataagggtgattgttggaaaaaatgttgtaataagtatattttaggtaatagtgtattgttaattgtttgttttgtgtagtgtgttgttgtttgtatgatttagtttttattgttttgggtattttttagttgtattttatttttggtatatttttggtgattaattaggtatgagagtttttttaaattaggattgttgttttaggaaggttggttatatttgttttttgatttggggagatgtagtttattaataaaataaagatattttttttgtttagttaagattttaaagtaggtgttttggtgtattgattattaattgaggatatggttttggttagagaatgggaggaggtggggattatgtttattttatttattttttttttttttttgtgagagaaagggttagttattttaaggtatggttagattaattttttttgtgtttttgttgaggttttgagttatttaggttagggagaatagtgattttgtggttttttttttgatttttaaaaagaatttagtgttgttttggggagtatgtgttttgagaataaaagtaatatttaattgtaatttgtgtagtttagaatggttattgtttttttttttttattatttgtagaaggtttggaagaatagatggagtttgtatttaagttgagtggttttgttagattaaaggtgattaaattttagagttttatgtttttttgtataggtttttggttattggtttgggaatttgaggatgttggtaagaatgtatatagtgagggaagggttatgtttgtgatttgtgggttgagtggattagaaattatgatgatgttataatatgggtgatatgttggtgttggtgtagggtgttgggggtagggggttttgtaggggtgtggagtggtattgtgttgttataggggtttgggtgttttaggtatttatgtgggtggtgtattagaaggggtattgttttgtttgagtgttgtttttggggtgaggtgggtatgtggttttataaggtggagtttaggtggttaaagtttggaaaggtagggaaggatttttttgttttttgtttgttttgttttgtttttgtttttgagaatggggagttggtttggatttagtttggggtttattgttatgtttttttttatggtgagattatttttttagttttaggtttatatttggggatgttttttaggtgttttgtaatttttggtattgtttttttgttttttgggataggattatattttttgaggtgttttggggttttggggggtggtgttttatgtgggttgtggggggtgggggtggtatgtgttgttgtttttggttaatgtggagttttgtgtggaggttatgtgtttttgtttggtgtttttgtgtgtgtttgggtttgttggtgtttagagtgtggttaggtggtttggattgagtaggtgggtgtggggtttggaggaggtggtggttggttgaggttagtaagagggatgtggttggtgggaggggttgggttgtggtagtgattttttgttgtagggtggtgggtggggttgtgggttttggaggggttggtgggtgggggttgttttgttttgtgtgtggtttgggtggagttttgtttttgtttttgttttttgggggtgtggttgtttgtgggtagggggttgggtgattattgggtgtttgttttggggtgttgttgaggagataatagggggtgtgggtttttgtttattttttttttttttttttttttttgtgggttttgttgggttttttattgtttgaagggatggggtggtgttttagggattagtggttttaggattaaattgtgggtagttagggttgtgattttttttgtgattgttttttggtgattgtagttggtgattgaggggtggtgtttttgggttttatgagggtttttttgtttttgtggttggatgtgtggatagtgtgggtggtggtaggttgggtatggggatggtgggaggtggtggtgagtttattgtgggattatttgggggtttgtttttggggtttgttttatttgttgaattgtgaagggggtggtggtggtggtttggaggtgtttttggtgggagttggggggggtgtttgtgtagggggagttaggtaggggtggagttatttggattggattgttagttttgtttattttttttttttttatgtgtgtgggttttggggtgttgagtttggggagatttgaaaaggtgtggggaggaagggggtggggttaggggttggagtgtaaggtgtgttttgattggttgggggtgattggtttttttttttttgtttggattagggttatgtttattttgggtttggtgttgtgtttaattttttgttttttttaaattttgttgttgtttttgattttaatttttagtttttgggaatttgttattttatgtttttggtattagttggtgtttataaaagttataatgttaaaaagattaataagagatatagtattttttatgatataatggtagtaaatataagttaaaatttagaggtttataaatattttgtttgttgttgggtaaggaagtttaaatttgagggataataggagtttaatattattggttattattagtttgggtgtttttttatttattatgttagatatagataaagtaggggtgggtattttatttgtataatgagttgtaggtagtattaagatggttttgggggtattgttgagttgaatttggaatatttttttatagttttggtgaaatgttaaagagtttatgggggaaaaattttttatttttgtgattttgtttgattttaaaaatttaagagttttatgattgagaaagtttagttaatttgattttttggaattaatattatatttaggttatattttttaatgtttatttagtagattttgataattttttttgtggttaattt

SEQ ID NO: 340 - DNA, 4528 bp, Artificial Sequence
  chemically treated genomic DNA (Homo sapiens)
tgtgtagatttgttaggaagagtataagaagaaatatttggatttttttgttaattttgtggaattttttaagaagtgtttggagagatggaagattatgtttgtaaaggagaagtgaagtttgaagagaaggtaaaaagtgataaagtttgttgtgatagggagattaaaaattatatttttttgaaatgtaagaaagggtaagaaaggaaagaaaaaggattgtaatgtttttagaaggttattatttgttttttttttgttttgttttgaatattgtttaaagattaaaagtggatatttaggtttatttgttgtggaaattgtaaagaaattgggtgaaatgtggtttgggtagttagttaaagataaataattatatgagtagaaagtagttaagttataggagagatatgaaaagggtattgttgtatattgtgttaagggtaaaagtgaagtaggaaagaagggtttaaagaagaataaattagaagatgaggaggaggaggaggagaaagaagatgaagatgaggaggaagagggtgaagatgaagaataaatggttattttttaatgatgtttgtgtagtgggtttgttttgttaagaatgtgaattttagtatagtttagtattagttttagtataaaattgtataaatttttgtatagtttataagattttttgtatagaaaatattttttttttttttttttttttttgagatagagttttgtttttgttgtttaggttggagtgtaatggtgtgattttggtttattgtaatttttgttttttgggttttggtttaagtagtttttttgttttagttttttgagtagttgggattataggtatatgttattatgtttagttaatttttgtatttttagtagagatggggttttattatgttggttaggttgtttttaaatttttgattttgtgatttgtttgttttggttttttaaaatattgggattataggtgtgagttattgtattttgtttaatgtttttaaatatttaatggtttttaaaaaatttattgtgtatggtagtatagtatatttgtaggaattagtattaatagtatattttgtgttttttaagatgttgtattttttaatattttgtaataaaattatgtgtattaaaaaaataaagaaattttgtgtgtagtttatatttatagtatatttttgtttaggtatttgagagaatgattaggaggggtttttggaggaggtggtttttgaatggagaatttatttttaaggattttgtttgtaatggttattaagtattttttgagttatttttatgtgttttgtagttttttgaaggggtgtgggatttattgatgttaattatttagtattatttttagattttaagaagttggggtgtgagttagtaattagtatagaaaagagatattaaaataagtttgagttggggagtgtttttttaattttagttttttggaagagattttttttttttttttgagatagagttttgtttttattgtttaagttggagtgtagtggtatgattttggtttattgtaattttttttttttgggtttaagtgattttttttttttagttttttgagtagttgggattatagatatgtatttgtaatttttattaaaaatataaaaattagttgggtgtggtggtgtatgtttgtaattttagttattggggaggttgaggtaggagaattgtttgaaattaggaggtggagattgtattaagatagtttgttttagttaaataatttggtgttagtgtaggaaaaggtggaaggtatggggttagtataggagggtttaatatttttaattttattaagttatattttggtaatttttgttttttatgagaagtttttgttgggtttgttttagtgttgttttgaggttttttttatgagttttgatagggtagaggttgttttgagtgttttttttttttttggtttaagagtggtttaaaagaaggatttttgattggaattggttattttgtgttattttttgatttttgattttgttttaaagggggatgtgggggaggggttttggtaggggtggttttgttttttttaggtttgtaagtttaggtttttgtttattgggtttagtttattttgtggttgtttagggaggttgttggtatttgtgatttatgattttttttttgagttttattgaggttatagttgtggttttgtttttttatgtttgttttttgttttttgtttgtgatgggtgtttttgaggattaatgagtgtgttgtatttattttttgggtggggttaagtgttgattaattgttgtttgggtgtttggttgggtttaaatgttttaattgttagtggtggtggggtgggtagagggttggggatggtaggtttaattaatgggtgggtatgttgtttttgtgaggaggtgtgttttgtggttgggtgtgtggtgtttgtggtggtgtagggagggggagggaggtaaataagatggtggtggtgtgttgggtgtggaagggggaggtggtttggggtgtttgtgagtgaggtgtggggtggtgaagggagtgtgggtggtggtatttgttgttgtggttttggatgggttgggttttttttgttgttttgttttttttatatgtgtggtggttgtggtgagggggatgtgttgtttggggtttggtatttttgggaattttttggtttggagtttgtggtttgtgttgttttggttgttgggagttttgtggagtttttgttgttgtgttgttttgtggattggatgttgagggtatttggggtggggtgtgtgtttgggtagatgtttgtggggaggggggtgtttgttgggttttggtgattattttgggggttgtgggttggtttggggggtgtttagtgtgggtttttgtgggtgttgggtagtgattagttttgagtggagttgttggttgtggtgggaggttttttggatgtttttagttttttgaatgtttgtttgggttggtgggagttggtgttttttgggaggtttgtttggttgtttgtggtggagtgtttgtttttgggataggtggtgggattggggtgttgttggagatgtttttagtgaagttgggttttttaggtgtgggggttttggggggtagtgatgttgtggatttggtttgtgggatgggtggtttggagaagattgtgtttggttgtgtttatatttgtttgtgggtttgaggtttttggaggatgatttagtattgaaaagttttggttggtttttttagggtttttgaggatgaagttgattttgattgggttgttttttagttttgaggtttgggttttattggaatttgtgtttgagttgttgttttggatttttggtgtttgttggtttgtagattttgtattgggtttggatttgtagttgggattgatgtgtagaataattgtttttgttggaagaagggttttttttttttttttggggtttttgttgtttttttttttttttttttttttgtaaaattttggagaagggaagttggaatataaggaaggattgtttatttgtggatttagggttggtggtgggattttaggattttgggtttagtatggaggtggtggatttgtagtagttgggtatgtttatggagggtgagttgatgttggtgggtatggatatgtttatttattgtattgattttattgaggttatttattagttgtgttgtaagtgggttaagtttattggtaagtatttgatgggggatttgttgggggaaggtttttatggtaaggtgaaggaggtgttggatttggagatgttgtgtaggagggttgttaagatttttaagaagaagaagttgtgaaggatttttaatggggaggttaatgtgaagaagtaagtatggtttgttggggttggggttgggttgggttagttatggtgttgatggttttgttttttttttttttttttttttttttttttttatttttttttaatattttgagttggatttgtttggtgtttgtgttttttgtgttagggagagtgtggttgggggtttgtgttatggatttttatttaggtaaggttagttgttgtagtggggtgtgtgtttgtatgggtttttggattttagttaaaatgttttggtagtgaaatttttttgagaagggagtggtttttaattttttaagattagttttttggtttttttagttgtttaaggagtagaggtgtttagtggaattagtttgtgtttgtttgggttttgagagtttgtgtgtggttgttaatatgttttttgtgtagtgtgtggttgttattggggttaggtgaaatgtgatttgtttattttgttagaggggaattttgggttgttaaaaataattgtttgtattggtttattagttagtaggagggaaatgtagtttttttttatttgttagggatgtgatgttggaagtatttttggtttttgggg

SEQ ID NO: 341 - DNA, 4528 bp, Artificial Sequence
  chemically treated genomic DNA (Homo sapiens)
ttttgggggttagggatgtttttagtgttatatttttggtaaatgaggaaaggttatgttttttttttgttgattgataagttggtgtaaatagttatttttggtagtttagggtttttttttgataggataaataaattatattttgtttggttttggtaatggttatatattgtgtagaaaatgtgttggtggttgtatataaatttttggggtttaaataaatataggttgattttattgggtgtttttgttttttggatagttgggggagttaaggggttagttttaggggattgggggttgttttttttttaggagggttttgttattagggtattttaattggagtttaagagtttatgtaaatgtatgttttgttgtgataattggttttgtttgagtgaaagtttgtaatgtaggtttttaattatgttttttttggtatggaggatataggtgttagatgggtttagtttagggtgttaagaggaagtaagggagggagggaggagagaaggaaggaagatagaattattagtattgtgattggtttggtttggttttgattttagtaagttatatttatttttttatgttggtttttttgttggggattttttgtaattttttttttttgaggattttgatggtttttttgtatagtgtttttgagtttagtattttttttattttgttgtaagagtttttttttagtaggttttttattaggtatttgttgatgagtttggtttgtttgtggtgtggttggtagatgattttggtggagttgatgtggtggatgaatgtgtttatatttattgatattagtttgttttttgtgaatatgtttagttgttgtgggtttattatttttatgttggatttagggttttggagttttgttgttagttttgagtttgtgggtgagtggtttttttttgtgttttgattttttttttttaaaattttataaagaaaaaagaaaaaaaaaaggtaataaaaattttaaaaggaagggaaaaattttttttttaatagaaatgattgttttatatgttagttttggttgtgagtttaagtttggtgtagggtttgtggattggtgggtattgggggtttgggatggtggtttagatgtgagttttagtgggatttgggttttagaattgggagatggtttggttagggttaattttgtttttggggattttggggaggttggttggggttttttagtgttaggttattttttggggattttaggtttatggataagtatgaatatggttgagtgtagttttttttgggttgtttattttataggttgggtttgtgatgttgttattttttgggatttttatatttggagagtttaattttgttgggggtgtttttggtgatgttttggttttattgtttgttttaggagtaaatgttttgttgtggatgattgagtggattttttggggggtgttgatttttgttggtttgggtgagtgtttggggggttgggggtgtttgggaggttttttgttgtggttaatagttttgtttagggttggttgttgtttggtgtttgtgagggtttgtattgggtgttttttgagttggtttgtgatttttaaggtggttgttggggtttggtaggtgtttttttttttgtaaatgtttgtttgagtgtgtgttttgttttgagtgtttttagtgtttggtttgtggggtggtgtggtggtgggggttttatggggtttttggtggttgaggtggtgtaggttgtaggttttgggttggggggtttttgaaggtgttgggttttgggtggtgtgttttttttgttgtggttgttgtgtgtgtggaggaggtggagtggtgaggggggtttagtttatttaaggttgtggtagtaagtgttgttatttgtgttttttttgttgttttgtgttttatttgtgggtgttttgggttgttttttttttttgtgtttgatatgttgttgttattttgtttatttttttttttttttttgtgttgttgtggatattgtatgtttggttgtagggtatgtttttttgtgaggatgatgtgtttatttgttggttgaatttgttatttttggttttttgtttgttttgttgttgttgatgattggagtgtttggatttggttgggtgtttgagtggtgattggttggtgtttggttttgtttgaggggtggatatagtgtgtttattggtttttggagatgtttgttatgggtagggggtgggaagtaggtatggggagatgaggttatggttgtgattttggtggggtttgggaagggggttgtaggttatgggtgttaatggtttttttgaatggttgtagggtgggttgagtttggtgggtgggaatttgggtttgtggatttggaaggagtggggttatttttattagagttttttttttgtatttttttttggggtgaggttaagggttaaaaagtaatataaagtggttaattttagttaaaaattttttttttgagttatttttggattaggggaaagagaaatgtttagggtggtttttgttttattggaatttatgggggaagttttaggatagtgttgggataagtttagtgggggttttttgtgaaaaataagagttgttaaaatatggtttgataaggttgaaaatattgaatttttttgtgttagttttgtgttttttatttttttttgtattagtgttaggttgtttagttggaataaattattttggtataatttttgttttttggttttaagtgatttttttgttttagtttttttagtagttgagattataggtgtgtgttattatgtttggttaatttttgtatttttagtagaaattataggtgtatgtttgtaattttagttatttagaaggttgagggaggagaattgtttgaatttgggaggaggaggttgtggtgagttgagattgtgttattgtattttagtttgggtaataagagtgaaattttgttttaaaaaaaaaaaaaagattttttttagaaaattgaagttgaaggaatattttttaatttaaatttattttggtattttttttttgtattgattgttggtttatattttaattttttggaatttggagataatgttggataattggtattggtaggttttatgtttttttagagaattgtaggatatatggaagtgatttaggaaatatttggtgattattatagatagaatttttgaagatggattttttgtttaaagattattttttttaagaattttttttagttatttttttaagtgtttggatggagatgtgttgtgagtgtgaattatatatggaatttttttgtttttttgatatgtataattttattataaaatgttaaaaaatgtagtattttaaaaaatgtaagatgtattgttgatattaatttttataagtgtgttgtgttgttatatataataaattttttaaaaattattaaatatttagggatattaggtagggtgtggtggtttatatttgtaattttagtattttgggaggttgaagtaggtggattatgaggttaggagtttgaaagtagtttggttaatatggtgaaattttatttttattaaaaatataaaaattagttgagtgtggtggtatgtgtttgtaattttagttatttaggaggttgaggtaggagaattgtttgaattaggatttgggaggtggaggttgtggtgagttgagattatgttattgtattttagtttaggtaataagagtgaaattttgttttaaaaaaaagaaaagaaaagaaaagtattttttgtatagagaattttatgagttatatgaaaatttgtatagttttatattgaagttaatattgagttgtattagaatttatatttttagtaaaataagtttattgtataggtattattaaaggatagttatttattttttatttttattttttttttttttatttttattttttttttttttttttttttttttattttttggtttgtttttttttgagttttttttttttgttttatttttgtttttagtatgatatgtagtaatattttttttatattttttttgtagtttaattgttttttgtttatatggttgtttatttttggttgattgtttagattatattttatttagtttttttgtagtttttatgataaataggtttgggtgtttatttttgatttttgggtgatgtttagagtaaaataggaagaaggtagatggtggttttttaggagtattgtgattttttttttttttttttttatttttttttatattttggaggaatgtaatttttaatttttttgttatagtgagttttgttattttttgttttttttttaaattttattttttttttgtagatgtggttttttatttttttaaatattttttggagaattttatgaaattgatagaagagtttgggtgtttttttttgtgttttttttggtaggtttgtgtg

SEQ ID NO: 342 - DNA, 4616 bp, Artificial Sequence
  chemically treated genomic DNA (Homo sapiens)
tgaaatggttttatttttttttagtttgtttaagttaatggagttttattagaatgtgagttataaaatagtagagttattttttatttaatgttgtatttgtagggtttagaatagtatttgaaggattggtggaggtttaataaattgttaaaagggtagattagttaggtgtgatggtgtgtgtttgtagttttagttatttgggaggttgaggtaggaggattatttgattttaggatttttgggttgtagtgtagtatattagttaggtgtttgtattaagttttgtattaatttggttgtttaaggatggttgaattgatttaggtggaaattggagtaggttaaaatttaatgttgattagtaatagggttgtatttgtaaatagttattgttttttagtttgggtaatatagtgagattttatttttaaaataaattttaaaaataattaattagaaaaaaaaattagtttgtaattttagtattttgggaggttaaggtgggtagattatttgaggttaggagtttaagataagtttggttaatatggtaaaattttaatttttattaaaaatataaaaattagttgggtgtggtggtaggtgtttgtagttttagttatttaggaggttgaggtaagagaattgtttgaatttgggaggtggagattgtagtgggttgagattgtgttattttattttagtttgggtagtagagtgtgattttgttttaaaaaaaaaaaaaaagaaagaaaagaaaagaaaaagaaaagaaaagaaaaaaattgggaggtttaagtttatttttggtgtttttatatttttttgttttatttttttgtatttagtttttttttgtaatttgtgttttatattagtttttaagtttttaatgtgatttagtatgagaattggattttgttatttttttgtttataatattttatgttttttttttgtttagaatattattttttttattgtttttattaatggaattggtatttttttaaggatatgattaaatttgtttatttttatattattttttaaagtagaatttatttttttttttttaatatgatgatattgatagggtttgtttttatttattagattgtgagttgtttagggtaggtagtgttttttgtttttgtttttgttttttttttttgagatagggttttgttttgttatttaggttagagtgtaatggtatagttttagtttattgtagttttaattgttttggtttaaattattattttattttagttttttgagtagttgggattataggtatatgttattatatttggttaatttttttgtatttttagtagagatagggtttggttatgttgtttgggttggttttgaatttttggatttaagtaatttatttattttagttttttaaaatgagggattgtgttttatttatttttatgtttttagtttatagtttagtgttggatttatggtagtattaaataaatatttgttgaatgtaatagtaaatagtattttagggagtaagaattagattaataaaggtggtaaaaggtttggagaaaaaaataatagtttaatttggttagagtatgagggagagtagtaggagataagatggaaaggttttttgggtaaggttttgaaggaagttggaagttagaagtatataatgtgtatattgtggtaggtagtggggagttaatgaaggtttttgagtaggagagtaatgtgttgaaaaataaatataggttaaatttattagagtttttttgatatatatatttgttttttatttaagtttaagtttgttttttatatatttattatttaatttatttttgggtttttttagtagtttgttttatttttttatttgttttttggtggagttagggatgtatatatgagttgtttttttttttagttagaggatatgggggttttagtttttttgtttttttttttttgtgtttggagttgggaagtaggttagggttagttgaggttggttggtaagtagttgggtggtgttagggagagtttgtatagtgttaggtggtgttttgggttttaagttgagtttatggttttgataattttttgtttgtgtatatatttgttttttattttatttttattttagttttggtatgggggagagggtatagggttagataaatttgtgagattttggttttatttttgtaaaagggtgttttgtgagttagtttgtttttttttaggtttgttttttttttatttagtttttgtttttaatgtatgtatagtttgtatatattgtgtgttgggatattttatagttagttgtatggtttttttgtgttttagtttttggttttttttgttgattttggtttttgttttaggttttattgtgtaattgttgttgttattgttgtttttggtgtttgtttatttttagaggttgttttggatgtaggaggatttttttttgggaggaggtttttttggggaagatgatttattgggtgaggaggatttgtttagtgaagaggatttatttagagaggaggatttatttggagaggaggatttatttggagaggaggatttatttggagaggaggatttatttgaagttaagtttaaattagaagaagagggttttttgaagttagaggatttatttattgttgaggtttttggagatttttaagaattttagaataatgtttatagggataaagaaggtaagtggttattaatttttaaatttaggttttaggaggtttatgattttttttttatattttagtttaggttttgtttatttagggaaggaggggagattgtattttttatagaagtttttttagaggttttatattaatatttttatttttatttttggaggtagaaagggatagatgtggagagaaaataaaaagggtgtaaaaggagagaggtgagttggatgagatgggagagaagggggaggttggagaagagaaagggatgagaattgtagatgagagaaaaaatgtgtagatagaggaaaaaaataggtggagaaggagagttagagagtttgaggggaagagaaaaggaaagtttgggaggtgaagtgggtattagagataagtaagaagagttggtagaagttattttattttaggttataatgaggaaattgagatttaggaagaagggatatagtaggtagagaaatgtggttttttgatttttaagttaggaatttggggaaaggggttggagattatataaggtagagggatgagtggggagaagaaagaagggagaaaggaaagatggtgtatttatttatttgggatttaggattgaagtgtttatttattttttttttttttttttttgagataaatttttatttttgttgtttaggttggagtgtaatggtgtgattttggtttattgtaatttttattttttgggtttaagtgatttttttgttttagtttttagttaagtagttgtgattataggtatgtgttattatgtttggttaatttttgtatttttagtagagatggggttttgttatgttggttaggttggttttgaatttttgattttaggtgatttaattattttggttttttaaagtgttgggattataggtgtgagttatagtgtttggtttgaagtagttatttatttttatagattttaagataatgattgtaagttggtaggattgttgtttggtttatttagttgtggtgttgagtttgggtgtggttttttgtgttttgtatttggtttgtttaaggtatttgttatttgtaatgtttttgtaaggtatttgtgtttgtgatattgttttggttgttaggaagggattggggttttaagtttgagtggtttattttttttatttatataggggatgattagagttattggtgttatggaggtgagatatttatttgttgtatagatttaatttgggaatttagttttgtggattttttttatagttgtttttgaatattggttttgggtgttttatttgttgtttattgttttatttttttattttttttatttgggttttttaagtttttgatttaggtgttagatttttttattatatttttttattttaggtgatttgttttggttttgggtgtttttagtttgtgtgggttgtttttagtttttggtggatatttgtttttagtttgttgttttttgtttggttttgtgttttttggaatttttgggtttttagtttttgttgtttttagaattgtgtttgtgtaataatggttatagtggtgagggggtttttttgttgagatttggggatggggtggggtgtagggaagggaattgttgtggtagtgtttgtttgggggttgggttggttttattgggtggggttggtttatttgtttttttttatgtagtgtaattgattttgttttttgggttagagatggttttgggttttgggtgggagtattgggttttgtagttgtatttgtattggggggttgtaggttgtttgggtttggagtatattgtggaaggttattgtttttttgttgaggtgagtgtggagttggttg

SEQ ID NO: 343 - DNA, 4616 bp, Artificial Sequence
  chemically treated genomic DNA (Homo sapiens)
tggttagttttgtgtttattttggtagggaaatggtggttttttatagtgtgttttgagtttggatgatttgtagttttttagtgtagatgtagttgtagagtttggtatttttgtttgggatttagagttatttttagtttaggaggtagggttagttgtattgtgtagggagaggtaagtgagttggttttgtttggtagggttagtttaatttttgggtaggtattgttgtgatggtttttttttttgtgttttgttttatttttaagttttggtggggagatttttttattattgtggttattgttgtgtaggtgtagttttgggagtggtgggagttggaagtttaggagttttagggggtgtagggttgggtagaaggtggtgagttgggggtggatatttattggggattggaagtggtttgtgtaggttggggatatttggggttagggtgggttgtttggggtgggagagtatagtgaggaagtttgatgtttaggttaggaatttagggaatttgggtagaaaaggtgagggggtgggatggtgggtggtgggtgggatgtttgggattagtgtttagggatggttgtaggggagatttatagagttgggtttttagattgggtttgtgtagtgggtgggtgttttatttttatagtgttaatgattttggttattttttgtataaatgaaaaggatgaattgtttaagtttagagttttaatttttttttggtgattaaaatgatgttataaatgtagatgttttataggagtattatgggtaataaatgttttaagtgggttaggtgtaaagtataggagattgtatttaaatttaatattgtagttgggtgggttaaatagtaattttattagtttgtaattattgttttagggtttgtaaaagtgagtggttgttttaggttaggtgttgtggtttatgtttataattttagtattttgggaggttagggtggttggattatttgagattaggagtttgagattagtttgattaatatggtgaaattttgtttttattaaaaatataaaaattagttgggtgtggtggtgtatgtttgtaattgtagttatttggttagaggttgaggtaggagaattatttgaatttgggaggtggaggttgtagtgagttgagattgtgttattgtattttagtttgggtaataaaagtgaaagtttgttttaaaaaaaaaaaaaaaaaaagtgagtgggtattttagttttgagttttaaatgagtgagtatattattttttttttttttttttttttttttttttatttatttttttgttttgtatggtttttaatttttttttttaaatttttggtttgggagttaagaagttatgtttttttatttgttgtgttttttttttttaggttttaatttttttattgtagtttaagatgagatgatttttattagttttttttgtttgtttttggtatttattttattttttaagtttttttttttttttttttttaaattttttgattttttttttttatttattttttttttttgtttgtatatttttttttttatttgtagtttttattttttttttttttttagtttttttttttttttttattttatttagtttatttttttttttttgtattttttttattttttttttatatttgtttttttttatttttgagagtggggatggggatattggtatgggatttttggaagggtttttgtggggagtatagttttttttttttttttgagtgaatagagtttaggttggggtatgggaggggagttatgaattttttggaatttggatttggagattgatgattatttattttttttgtttttgtgggtattattttggggtttttgaggatttttaggagttttaatagtaggtagattttttaattttagggagttttttttttttgatttaggtttaattttaggtagatttttttttttaggtagatttttttttttaggtagatttttttttttgggtggatttttttttttgggtgaattttttttattgggtagattttttttgtttagtgggttattttttttagaagagtttttttttaagggggaatttttttgtatttggggtaatttttggggatggataggtattagaagtagtagtgatagtagtagttgtatagtgaggtttggagtaggggttgggattaatagagggagttaggggttggggtataggggagttatgtggttgattgtggggtgttttagtatatggtgtgtatgggttgtatgtgtattggaaatgagagttgggtgggggaggagtaagtttggaggggagtaggttgatttatagagtgtttttttgtagagatggagttaaagttttataggtttgtttggttttgtgtttttttttttatattaaagttaggatgggggtggagtgaggggtaggtgtgtgtataggtagaaggttattggggttatggatttagtttggaatttaaggtattatttggtattatgtaggttttttttggtattatttagttgtttgttagttagttttagttaattttggtttgttttttagttttaggtatagaaggggaaaggtaggggagttggggtttttatgttttttggttgagagggaaagtagtttatgtatatatttttgattttattaggaagtaggtaaagaggtagggtaggttgttaggggagtttgagggtgagttaagtaatgggtatgtgggagataaatttgagtttgaatgaaaagtaagtgtatgtgttagaggggttttgataggtttaatttatatttattttttaatatattatttttttgtttaaaagtttttattggttttttattgtttgttatgatatgtatattgtgtatttttgatttttaattttttttaaaattttgtttaagagatttttttattttgttttttattatttttttttatattttagttaaattaaattattatttttttttttaaattttttattatttttgttaatttagtttttgttttttgaaatgttatttattattgtatttaataaatatttatttagtattattataggtttagtattgggttatggattagggatatggaaatgaataagatatggttttttattttgggaggttgaggtgggtggattgtttgagtttaggagtttgagattagtttgggtaatatggttaaattttgtttttattagaaatataaaaaaattagttaggtgtaatggtatgtgtttgtagttttagttatttaggaggttgaaatgggatgatggtttgagttgaggtggttgaggttgtagtgagttgagattgtattattgtattttggtttgggtgatagagtaagattttgttttaaaaaagaaaaataaaaataaaaataaaaaatgttatttgttttgagtagtttataatttagtgagtgagggtaaattttgttaatattattatattgagggaagagagatgaattttgttttagaagataatatagaagtaggtaaatttgattatgtttttgaagaaatattagttttattggtaaaaataatagggagaatgatattttgggtaaagggaaggtataaaatattatgagtaggagagtgatagaatttagtttttatattaggttatgttgagggtttgagggttagtatggagtatagattgtaggggaagattgggtgtaaggagatggggtagaagagtgtgaggatattaagaatgggtttaggttttttagtttttttttttttttttttttttttttttttttttttttttttttttttttttgagatagagttgtattttgttatttaggttggagtgaagtggtgtgattttggtttattgtaatttttattttttaggtttaagtgatttttttgttttagttttttgggtagttgggattataggtatttgttattatgtttagttaatttttgtatttttggtagagattggggttttgttatgttggttaggtttgttttgaatttttgattttaggtgatttgtttgttttggttttttaaagtgttgggattataggttggtttttttttttaattaattatttttaaaatttattttagagatgggattttattgtgttgtttaggttggagggtggtggttatttataggtgtgattttgttattgattagtattgagttttgatttgttttaatttttatttgggttagtttaattatttttaggtaattaggttgatgtagaatttagtgtagatatttgattggtatattatattatagtttagaaattttgggattaagtgatttttttgttttagttttttaagtagttgggattataggtatatgttattatatttggttagtttgtttttttaataatttattaagtttttgttagttttttaggtgttgttttaggttttatagatgtagtattgaatagagaatagttttattgttttgtagtttatattttagtaaggttttattggtttaaataaattaaaagagaataaggttatttta

SEQ ID NO: 344 - DNA, 4374 bp, Artificial Sequence
  chemically treated genomic DNA (Homo sapiens)
ttggtgtagtagtgggggaggggattggtgagaggggaggaaggaaggggggaggaagggggagatttgtttgaatattgtaataaaaataaagtgagaagaaagaagtggatttatttttatgaggtattttttttggttgttatagtttttgttaagagttttgtttggttggggttttttgtgttgttgttgttgtttgaagattataatggtttgaaatgatggtgttttaaaggagttgttggtgagagttttttttatggatgttgttgggttggtgtgtgagagtaatttttagatttttgggaaggagatagagattgataataaaatgggttgttagtggttggagagtgagagataaagagtgtgggtgagggaagtggttgtagttagtatatttatgttgattggtgatggtttaagtgtgttaatgtgtgtgtgttggtgtttggttttgtttttattgttttttattggtttattagtgaagtttgatttttgttattattttttagtaaaatatttttttttgtgtttgaattagagtgggaaatgaggttgagttatggttttttttttaaatttattaattattttgtaatatgtaaatgtattgtttgtttttatataaaatattgttttatgtaaagtagtgttggggttttgtgttagttgattggatgttttttttttttgtttggtgtaattggtttgtttgtttgaatatgaatatatttgtttttggttttgttggtgggttttggtttttttttttggtgtagggtttttgagtttgggttttggtgtttgtttgtatttttttgttttgtgtatgttgagatttggtgtggtttgttttgttgttgtgaatttgagtggttaagtgaaggtttttgggttgggggttgtgtttttattttttttaagttggatttgggatttttagtttttggagggtgtaagtttttgtgttgtttttttttgttaattttaggatagtgtggtttgttgttttgtttttgtttgtttttattttattttagttggggttttaagatatagagtatagtggtggttgtattttagtttatttggttttttggaagaagaggaaaggggtgggagtgttattgggttttggtagttttattttagttgtggaggttgtggtgaagtttaggttgagaggaggttgttgggttgagaattaaatgaggttagaggtttttttagtttaagtttttagggtttgtttaaattttttattttgttttttttgttttttttttttttttttttttttttggaagttgtggtgtgtagtggagtagaggtatagttttggttggagaggtttgagtaaatatgttatttattttgtgtatagagggtttttgtgaaaagttttgaagagtttttattaaatatttattaattttttttatgtgttatttgttgattaagtgtggttgttttttgtagtgtttgagaggaggggaagttaggggagataagaggggagggggagtggaagtttgggtgggggggtggatgattaatgttgggagggattttttttttttttttgtgtgtgtgtgtgtgtgtgtgtgtgtgtgtgtgtgtgttttattggtgatgttggtatgttagtgtgtgttgtgtgtgttattggttatttgtgtgtggtgtgtgtgtttttgtattatgatttttttttttgggtttgtttagtttatggaggtagtttttttttagttgttgttagaaaattggggaggaaagtaagtaaatggttttttttttttgattatatattagaagtttatttgttgaatgttgtatgattaggatatattttagtatattttaaaggtgttttttggagtttgtagttaaggtgataggagagtgagtggttgtttggttttgtgttgttttgagtttttttggtggttttgggttatggagttgggaaggagaaggaaggtttgggttgttgtatatattttaggatagggtgagggggaatagggttgaagagttgaggtagggaggttgaaatgaagtagttgaagggtatgttagattttttttgatttagggaaagtgttgaaagttagagtttattaataaaatttgtgtgatttgaatttgttgttgattggttgtgttgttgtagtttttggtagttgggatagtgaggatgttgtaagttgttttgggttgttgggttatatgtgggttttatttttttgtttttgtttgggatttagtagttttgtgattaaggagtttgggtagggtttttgggaagtaaaggtttttttggttttagttagaggtggggttgtataatttttttttttttttgggttggggagggttgttggttttaatttttttttgggagtttgtagtgttgggaggaaatttgggttagaggtgaaggaggtggtgttgggtgtttaggtttgtggttttttgggtgaggttttattttgtaggagtgtgatttttggaggatgttggtaagtggggttgtggttttgagttttagattagtgaaagttggttttttttttttttttttttttattttttaagtgagtattaaagaagtttggatttaagatttaagtttgttgtgtatgagtgagggatttgtgggggggtgggggggggggaagtgattttgtttgaattggaggtgagtattatttttataattttttaattagtgattgagtggattagtatttttttaagttttgttttggaaagaagtagttgtaattttgttgttatttttttttagggtattggttttttgaattagtttttttttttatttttttaatttttattttgttgtggagaaaagttttaataaaaaattagaaaaggtaaggagtgaggagtgaatgttattgatgttattgggtggggaagggggttttgggaaagatttttggaaatttttttgtataaataaaaaataaaaaggatttggttgttttttatgtgttaatatttggggaggggagtttaattttagaatgaggttgagtttttaaagtttaaggagagaggggtgagagtgagatttttttgttttttttggattggttttaaggaaggtgggggtgttgttttattttgtggggagttttattttttttgttaagtattggttttgggggtgaagtggtttaggggtgtgggggttgagattgaggtgtgggtgtggttgttagaggtgtgtataaaattgagataatttgtaggttgttattttaattgtggttattaatatgtttgaggtttatttgttgttttttaagatgtgggggggtggtggggattgtgttttaggttttgttttttttttttgtttttttataggtttttgtttttttttattttttgttttttgtggttagagggaggattttttaggttggtgggtgtgtttttgtgggggttgttggggttgttttatttggtagtggggttgtttgtgtggagggagttttgttgggggattgtggtttgttagagtttgtttagagtttttagttagtattgatgtgttaatatgaggtgaggtaagtattttatttgtattgatttttggtatttttttgtgtttattttattaggtttttggggaggtaaagaagtgtttatttttggggggaagtgtttttagtttttagttttagaattaagagttttttatttggagttttgatagttttgatatttttaaattttttttttttttggttaagtagaggtgtagtgttggtgtgttggaaagggtgaagattggtattttttggagaaggaaagttttggtagatatttgtgttattttgtagtgttttaaatgtttttttttttgtagattttgggaaggtgggattttttgtttgtggagttggtaaatgggtttagtgagttttaaaggtaaaggtttttattttggttgtttagtttttggtgttttttttatttttaggtttttgttttttttttttttttagtaatttgttggtttttgttaatttggtagttttgttgagtttagagtttagaaaagttaagaagattttagagttgttttgtggtatttttaggttgtggttattgtttggtttggggggaagttgtggtgtttttgtttttttttgttttttgttaaatggttagtgttaggggttttttgggtttagtttttagtttttttttgtttgttttgggaggttagtttgtttttttttttttttttttttttttttttttttttttttttttttttttgttttttttttgtttatttttaaaatatttttaaaataatattgt

SEQ ID NO: 345 - DNA, 4374 bp, Artificial Sequence
  chemically treated genomic DNA (Homo sapiens)
ataatgttattttaaaggtattttgggggtgggtagggagaagatagagagagaaagagagagagagagagagagagagagagagagagagagataggttggttttttagagtgaatggaagaggattgaggattgaatttagggagtttttagtattggttatttggtaggaggtgaggaagggtgagggtattgtggtttttttttaagttgagtagtggttatagtttgaaggtgttatggggtggttttgggatttttttggtttttttaggttttgggtttggtgaggttgttgggttagtgggaattggtaggttgttggagaaaggagagggataaaggtttggaagtgggggaggtattagggattgggtggttgggatgggagtttttgtttttagggtttattggatttgtttgttagttttgtggataagggattttatttttttagggtttgtaaaaagagagatgtttggggtattataaagtgatgtaggtgtttgttaagattttttttttttaaaaaatgttagtttttattttttttagtgtgttggtgttgtgtttttgtttgattggggaaagagagagtttggaggtgttagaattgttagaattttggatgggaggtttttggttttgaagttgggagttggaggtatttttttttagaagtgggtatttttttgtttttttgaaggtttgatggggtgggtataggggaatgttagggattggtgtgggtgagatgtttgttttattttatgttgatgtattaatattggttagaagttttgggtaggttttggtgagttatggttttttagtgggattttttttatgtagatagttttgttattgggtgggatgattttggtggtttttgtgggaatgtatttgttggtttgagaggttttttttttggttatagggggtggagggtaggggggaataggggtttgtggggaggtggggaaaggagatagaatttaaagtgtaatttttgttgtttttttgtgttttggagggtagtaagtgggttttgggtgtgttggtagttgtaattaaaatggtgatttgtgagttgttttggttttgtatatatttttggtaattgtgtttgtattttagttttggtttttatatttttaggttgttttgtttttagagttggtatttggtagagggagtgaggttttttatgaggtagaatagtatttttattttttttgagattagtttagagagaatgaggaaattttatttttatttttttttttttaaattttgaaaatttggttttattttggggttgaatttttttttttaaatattgatatatgggaagtagttaagttttttttgttttttgtttgtgtggaggagtttttaggagttttttttggagtttttttttttatttaatgatgttagtggtatttattttttgttttttgttttttttgattttttgttaaaatttttttttgtagtgagatgggggttggaggggtgggagaaggagttgatttaaagagttagtgttttggggggaaatagtaataagattatggttgtttttttttgaggtaaagtttaagaaggtgttaatttatttggttgttaattgagaggttgtaaaaatgatatttgtttttagtttggatagaattattttttttttttttgtttttttgtaagttttttgtttatgtatagtggatttgagttttgagtttaagtttttttaatgtttgtttggaaagtaaaaggagagagaaagagaaagttgatttttgttggtttgggatttagggttgtggttttatttgttggtattttttgaaagttgtgtttttgtgaaatgaaattttgtttaggaggttgtggatttggatatttggtgttattttttttatttttgatttaggtttttttttggtgttgtgagtttttggggaagggttagagttggtagttttttttagtttggggaggggagagggttatgtgattttatttttggttagggttggggaggtttttgttttttgggagttttgtttgggttttttggttgtagggttgttgggttttaggtaggaatgagagggtgaggtttatatgtggtttggtggtttagggtggtttgtagtgtttttattgttttggttgttaggggttgtggtgatgtggttagttagtagtgagtttaggttgtgtagattttattgatgagttttgatttttagtattttttttaagttaagaagagtttagtgtattttttggttgttttattttagtttttttgttttagttttttagttttatttttttttgttttgttttggggtgtgtatagtagtttaggtttttttttttttttttggttttgtggtttgaagttgttgagagagtttgggatagtgtaggattaggtagttgtttgtttttttgttattttaattgtaggttttgaggggtgtttttggagtgtattgaggtgtgttttaattgtgtggtatttaataaatggatttttggtgtgtggttagaagagaaaagttatttatttatttttttttttggttttttggtaatagttgaaggggagttgtttttgtggattgagtagatttaggagagggagttgtggtgtggagatatatgtattatatatagatgattggtggtatatatgatatatgttgatatattgatattgttagtgggatatatatatatatatatatatatatatatatatatatagagagagagagagaattttttttagtattggttatttgtttttttatttaggtttttattttttttttttttttattttttttggttttttttttttttgggtgttgtgaaaagtagttgtatttagttaataaatggtatgtgggagaagttggtgagtgtttggtgaggattttttagggttttttataagaattttttgtatataaagtaagtggtgtgtttatttgggtttttttagttagagttgtgtttttgttttgttgtgtattgtggtttttgaaaggagaaaggagagaagaaagggtggggagagtggggtggaggatttggataggttttggaggtttgggttggggaggtttttggttttgtttagtttttggtttggtaatttttttttggtttaggttttgttgtggtttttgtagttggaatggagttgttaggatttagtgatgtttttgttttttttttttttttttaaggggttaggtgggttggggtgtggttgttgttgtgttttgtgttttggggttttggttgggatggggtgggggtgggtgggggtggggtggtaggttatgttgttttggagttggtaagaaaggatagtatagaaatttgtattttttgaggattgggagttttgagtttagtttagggggagtgggggtgtgatttttaatttagaaatttttatttgattgtttaagtttgtggtagtagggtgggttgtgttgaattttggtgtgtgtggagtggggagatgtaggtgagtgttagagtttgggtttgggggttttgtgttggggagaggagttgggatttattggtggagttgaaaataagtgtatttatatttaaataaatggattaattgtattaggtggggagagggagtatttaattggttggtgtgaggttttggtgttgttttgtataaagtaatattttgtgtgagagtgagtggtgtatttgtatgttgtggagtgattagtgggtttgaaaagggaattgtggtttggttttattttttgttttggtttaggtgtaggaggaagtgttttgttggaggatgatgatagaggttaggttttgttaatgggttagtgaggagtggtggaggtgaggttgggtgttggtatatatatattaatatatttgagttattattaattagtataggtgtgttggttgtagttattttttttatttatattttttattttttattttttagttgttgatagtttattttattgttaatttttgttttttttttaggaatttgagaattgtttttatatattaatttagtaatatttgtggagaaaatttttattagtaatttttttaaaatattgttattttaaattattgtggtttttaagtaataatagtagtataaaaaattttaattaaataaaatttttgatagaagttgtgataattagaaaggatgttttataaaggtgagtttgtttttttttttttgttttatttttattgtaatatttagataggttttttttttttttttttttttttttttttttttttgttggtttttttttttattgttatgttgg

SEQ ID NO: 346 - DNA, 2534 bp, Artificial Sequence
  chemically treated genomic DNA (Homo sapiens)
aggtaggaaagtgggatagttggggagttggattttattttttgtgagttttgttggtatttgatggtatgtggtttggagagggtaggtgatttggtgtggagggttagagggtaaatttttaaataagtggtaataggttattaatttgaaagggaaaattgtgtagtgatgggaaatgtgtttaataaatttattgggtgattaattataaaggttgggttggagttttagaggttgtttgttaaatattttattaagtggtattttgaaagttgttatttgtgtattttgggagtttagaggggattttgagggggaatgaggtttggaggatggaattatttttaggtagattgagaaggagtttggattttatttttaaatatagtttggagtttataggttagaggttttaatgggagaaaagttaaaggaagagggtgtagaaaggagttttagggaattggtggttatgtgattttgagtaaattttatttttttttgagatttagtgtttttatttttatggttttgtgtgtgttatagagatatggtggggattaaatttgattgtgatatgaaagtgtttgggaaattttatggttttatttaaatatgagttatttttatttgaattaaggggggaagttatttggtaggattaggaattttatttttttgaatttttatgggttttgttgaggttgaagtagttaggggttaaagttagtttttagtttttggaagggtattgtgaaagtggatttgatttgagaagttgttttttgatgtgggtagttatgtgatgttagttttgaataagagggggtagtttggagtttggaaaggtgttagtgtaggtggggtttatgtttagattttttttgttgattgttttgatgatttatttttatattttagtttttttatttttattgtagagttggaaagggtgtggggaagagaggagagggaggtaggttttgggttttggttttgttttttgtttttttttatttttttttgggtttggttatttagttaaaaggtaggttaagagtaggagagatatagagtttggtattggttttaggtagtagttagtttgttgtttgtttgtgtgtttttagagttatggagagagttagtttgatttagaaggttaagttggtagagtaggttgaatgttatgaggatatggtagtttttatgaaaggtgttgtggagaagggtgaggagtttttttgtgaagagtgaaatttgtttttagtagtttataagaatgtggtgggtggttagagggttgtttggagggtgttgtttagtattgagtagaaaagtaatgaggagggtttggaggagaaggggtttgaggtgtgtgagtattgggagaaggtggagattgagttttagggtgtgtgtgatattgtgttgggtttgttggatagttattttattaaggaggttggggatgttgagagttgggttttttatttgaagatgaagggtgattattattgttatttggttgaggtggttattggtgatgataagaagtgtattattgatttagtttggttagtttattaggaggttatggatattagtaagaaggagatgttgtttattaattttatttgtttgggtttggttttgaatttttttgttttttattatgagattgttaatagttttgaggaggttatttttttggttaagattatttttgatgaggttatggttgatttgtatatttttagtgaggatttttataaagatagtatttttattatgtagttgttgtgagataatttgatattgtggatggttgataatgttggggaagaggggggtgaggttttttaggagttttagagttgagtgttgtttgttattgttttgttttgttttttttagttttttattttgttgagaggattagtatggggtgggaggttttattttttttttttaggtgttgtttttgttttaaagggttttgtggagagggattggtagagttgaggttatttggggttggggattttattttttttgtagttgttgagtgtatttaattattggttatgtttttatttttgttttttgtatttgtttttttttgattttaggattaggttattttttttttttttttgttttttttttgtttttgttgtttttgattgtaggaattgaggagtgttttgttttgtggttgagaattggatagtggtaggggttggagatgggtgtgtgtgtgtgtgtgtgtgtgtgtgtgtgtgtgtgtgttagtgtaagattgagattgagggaaagtatgtttgttgggtgtgattatgtttttttttaataaagtttttttgtgatattttttttgttttttttttagtttttggtgatgggttgggagtgggattggaatttgatttagagattttgattttggatttttgagttagggttttgaattttttaggtggtttagtggtttgtatgtaagattttgagtttaggtgaggttggggttt

SEQ ID NO: 347 - DNA, 2534 bp, Artificial Sequence
  chemically treated genomic DNA (Homo sapiens)
ggattttggttttatttggatttaaagttttgtgtgtgggttattgagttatttagggagtttagggttttaatttagaggtttaaagttagggtttttaagttagattttagttttatttttagtttattgttaagaattggaagagagataggaggagtgttataggggaattttattgagaggaaatatggttatatttagtagatatgtttttttttagttttggttttgtattggtgtgtgtgtatatatatatatatatatatatatatatatttatttttagtttttgttattgtttagtttttagttataaggtgggatattttttaatttttatgattagaggtagtaggggtaggagggaggtaagaggaggggagaagtagtttggttttggggttgggaggaagtgggtgtggagagtaggggtgggggtatgattagtggttaggtgtgtttaatagttgtaagaagagtgggatttttagttttaggtggttttagttttgttagtttttttttatggagttttttggagtaagaatagtgtttaggggagaagggtggggttttttattttatattagtttttttggtagggtgggggattggagggggtagggtggggtggtggtgggtaatatttagttttggggtttttggggagttttgttttttttttttttggtgttgttggttgtttatagtgttaggttgttttgtagtagttgtatgatgagggtgttgtttttgtaggagtttttgttgagggtgtgtagattagttatggttttgttgaaagtggttttggttagagagatggtttttttggggttgttggtgattttgtagtggaagatggaaaagtttagggttaggtttaggtggatggggttggtgggtggtattttttttttgttgatgtttatggttttttggtaggttgattgggttgagttaatgatgtgttttttgttgttattggtggttattttggttaggtagtggtagtagttattttttatttttaggtagaagatttggtttttggtgtttttggtttttttgatgaggtggttgtttagtaggtttagtatggtgttgtatatgttttggagtttagtttttatttttttttggtatttatgtattttgggtttttttttttttgagttttttttgttgtttttttgtttaatattggatagtattttttaggtagttttttggttgtttattatgtttttataggttattgagagtaggttttgttttttgtaggagagttttttgtttttttttatggtgttttttatgaaggttgttatgtttttatagtgtttggtttgttttgttagtttggttttttggattagattggttttttttatggttttggggatatataggtgggtggtgggttaattgttgtttgggattaatgttggattttgtgttttttttgtttttggtttgttttttggttgggtggttaggtttagagaagggtggggaggagtagggggtgggattagggtttaagatttgtttttttttttttttttttttatattttttttggttttgtagtaaaggtaaaaaggttgggatgtgggggtgaattattagaatagttagtaggagaaatttgggtgtgggttttatttgtattggtatttttttaggttttaggttgtttttttttgtttggggttggtattatatggttgtttatattaggaaatggttttttaaattagatttatttttatagtgtttttttaggggttaaggattggttttagtttttggttgttttagttttgatagagtttataaaggtttaggaggatggggtttttaattttgttaggtaatttttttttttggtttaggtgaggataatttatgtttaggtagggttatggagttttttaagtatttttatattatgattgaatttaatttttattatgtttttgtgatatatataggattatagagatgggaatattaagttttagagaggggtgagatttgtttaaagttatatagttattaattttttgaaatttttttttgtattttttttttttagttttttttttattgaggtttttgatttatgagttttagattgtgtttggaagtgagatttaggtttttttttagtttatttgaagatggttttattttttaggttttatttttttttagggttttttttgagtttttagaatgtgtaggtggtagtttttagagtgttgtttaatgaagtgtttaataagtagtttttgaagttttagtttagtttttgtaattagttatttagtaggtttgttggatatattttttattattatataatttttttttttaagttggtggtttgttgttatttgtttgaggatttattttttggttttttatgttaggttatttgttttttttaagttatatgttattaggtattagtggggtttatagagggtggggtttagttttttggttgttttatttttttgttt

SEQ ID NO: 348 - DNA, 10001 bp, Artificial Sequence
  chemically treated genomic DNA (Homo sapiens)
ttaagggatttgtttgttttggttttttaatgtgttggaattataggtgtgagttattgtgtttggtttaataaggaattttttaaataaagttttgtggggttgattagattaatttatattttttgagtagattttggtataatttattatttgtagtattgaatgttaaggtttgttttttattttgaaattatatttttttttttttattggaattgaaattttatttttttatgaaatgatagtgatggtggatggtatttgttttttttaatatttttatttgataaaataaaagttagtaatttattttgatttttaattttttgttggtgtttgaaattttaaaattgagatttaaagtatagttttggttttggagagatttttaggagagttagagtttagaagggagtaggatttaggaggtttttattttttagtattttagttgagttagttgggttatggaatattattgagtaattaaaatattattaatagataaaaaaagtttattgaatataaaatttaaaggtattaatagttttgggtttaagagatttatggtaggaagttaagagttttgttttagggttggtttgggtagttttggaagaagttattgtatatgatagtgatgagtgttaggaaaatagtatatttttggaagtttatttgttggttattgtttttatttaggttgtttattagtttttttagtttttttttatttatttttttttgaaagtgataggaaatatatttattattaagttagttttaattttagttttattaaatatttagatttttatatatttaggttggtttttagttttttttttttattgggtagttgggtataaggtgggtaggaggttttgggagttattaagagggtttagtgagtaaggagagagatagatatttattggtgagtatttttagtgtgttttttttttggatatagggaggatattggatgtttttttgagtatgtattagtttgaattttataggagtttagtgaggtaggtattattattttattttgttgatgaggaaattgaaggttgttgttttttaatattagttaggtagatttagaaaagaatattttttattttttaagataaggttttgttttgttgtttaggttggagtgtagtggtataattataatttattgtagttttaattttttgggttttagtaatttttttattttagttttttaagtagttgggattataggtttatgttattatatttagttaattgtttatttttagtagagataaggttttgttatgttgtttaggttggttttggtaattagagtgattttattttgttatttaggttgtattatagtttattgtaattttgaatttttgggtttaagtaatttatttaagtagttgggattataagtgtatgttattatgtttggttaatttttatttttatttttgtagagatggagttttgttatgttgtttaggttggttgaatttttgggtttaagagatttttttgttttagttttttatattgtggggattataggtataggttattgtatttagttgaaaaatatttttttaatattagttgaaataattagaaaaatttaattagttataaaaataaaattaaaaaaaggaaagaaggatttgttttatgtgtttaaagtttgatatttaattttgggaattattaatgagttagtatagggagggtgagggataaattgaaggttgatgtatttttttataaaatgttttagattatatattttagttgggtttttttatttttatatatttttttagtttggtatataaaaatggaaagaggttaagtatagtgttttatatttgtaattttaatattttgggaggttgaggtgggaggattgtttgaatttaggagtttaagtttagtttggataatatagtaagattttatttttataaaaataaaaattggttaggtatggtgataatatttttgtagttttaattatttgggaggattgtttgagtttaggagtttgagattatagtgagttatgatttagtttgggtgatagagtgagattttgtttttttattataaaaaaaaaaaaaaaaaaaaggagtttgggtatggtggtttatgtttgtaagtttagtatttttagaggttgaggagggtagattatttgaggttaggagtttgagattagtttgattaatatgatgaaattttgtttttattaaaaatataaaaattatttgggaagttgaggtaggtagattatgaggttaggagtttgagattagtttggttaatatggtgaaattttgtttttattaaaaatataaaaattagttgggtgtagtgggatgtgtttgtagttttagttatttaggaggttgagataggagaattgtttgatttttggaggtagaggttgtagtgagttgagattgtgttattgtattttagtttgggtaataagagggaaattttattttaaaaaaaaaaaaaagaaaagaaaagagagagagagaatgtgttagtgttgtgtgattttgggataattattttttttttttgggttttggttttttaagtttttaatgataggattaaatagatggatttggaaggtttttatagtatatggttttttggaatgttgtaggaaatagttattaattaagtatttttatttgggttttatttttattttagtggagttatgaagttaaagtggggagggggttgggttttattttggtatttgtattgataggtatttggaattgggggagagatttaatttgtatttttatatttatattaggattttttttataggtttgtgttatttatttttataaagttgggtagttttttgtgtagaagtttttttattttttttttatttagtttgaatttgttgtttttttggtaggagtatttgtggaaggtagtgattagtatagttagtgtttgttttagagaattgtatattatggatttgtggttgtagaggtgttaggtgatgggtatattgttgaggtttttggggttttagtttagtttgtaggatttatttttgttttatgtttttaagttattttataaaatttttttttgaatgggaaggtaggggttgtattttttttttagattgtggttttttgaggttggaggtgatatttttattttattttgagggtagatgttaaagttttttttgtgtttgggagttattaagttttttttgatggtatttgggatatttttttgagggtagggttttttattttagtgtttgttagaagggaaatgatagggtgattagagttttattttgatggtatttgtgtaggttttggggagtagggttatatgtattggttggtagatgggggtttttgtgtagtttggtaggagttatggttatagtttaggagtaggaagttttttgaaggagttgtttttttttttagatttgggatttttgaagttagaggtatttttttttgttatttaattggaagtttttttgggtaggagtgtttttttttttagattaggagtttttagagggtggggaatgtgtttttttttattttgaaggtttttgagtttttaggtagataggggtatggatagggtgggggtaatttaatattttttttattaggaaggattttgttggaattagaattaaagatatgaaatgtttattgttttgggattaggatgggatagattttagtggtaaggtttttgagaatatttagattagtttggaaaggttaggtaggttttagggtgaggttagaggagttatgttagaggtagggtatgttttgggtttattatgttagttttgtttttattgaggtagggggtagagttttgttgtttggggttatgatttaggtagagttttgagatttttgttttttgtattttagttttgttagaatttaggattttgtaaaaaaaaaaaaaaaaaaaaaaaaaaattttaggattttttttgtagtaatgtttatatgtatattttttgtttttaggtttagatttttaaagaagggtttttagattgagatatttaggggagggttttagagtaatttttgtattgagattttatagaggaatttggagaaaaattttttagttggttgggtgtggtggtttatttttgtaattttagtattttgggaggttgagatgggtggattatgagattaggagattgagattattttggttaatatggtgaaattttatttttattaaaaatataaaaaaattagttgggtatggtggtgggtgtttgtagttttagttatttgggaggttgaggtaggagaatggtgtgaatttgggagggggagtttgtagtgagttgagattatattattgtattttagtttgggtgatagagtgagattttattttaaaaaaaaaaaaaaaaaaaaaaaattttttagttaatattttagtattttatagagagtttttttaagggggaaggtttagagaggtttaggttgattttattagggaagttggaatgagagaattgtggagataaagatagagatttatggggattttttttattttgtttttagtaggatagaggtatttattagattaggtggtagagatagatttaggaaggagagtaaggtagttaggtttttagggtgaggatttatatgtgggttttattggtttttaatttggtattttaaggaaattaaatttgttttaatttgattttattaaattttggttttttgttatttttatttatttttttttagtttttttttttttagagagtgttagttttattattagttgggggagggttttaggttaggttaagggtagtttttgagtttatttaggttatagtgggaagtgggaggtgttgtggggattgggtattttggattggggtgaggggaggtaatttttgttttggggtttggagattggtgttaggttttatttttatgatatgtttgtgagttatagtttatttttgtgtgagaggttgtgagtatatgttgagattttatggtttagtgtttgtgtatatatatgtgtttgtgtgtgtgagagagaagtaatttggggttatttttaggaagttgggggttagaggaggtagttgggggatattaggaggagaaggataggattgattttagggtatggatgaagtggagtgatttttaatggttagtattagaatattttttaatgaggtaatgaggtaattaagtgtgtttagaaatatttgggaaggtttttttgtgtaggaaggtgtttggaaggatggggaagtagtgagaaatggggttgttttatatatagttgtagttgggttgggttatagtttgtggggagtataaggaagttttaagtagttaaaggttgaataggaaaattttggtttttttttttttagtttgagggttgggtgggtgggtaggggtatatttttatttaaggttgaaaatattagttggatagttttttaagttagaatttaggtttgaagtatagtttttagttatagtttttttttattgttttttatatatatgttttttttagatttggagaaaggtaaatattgtggttatttagagtttagtttaagggagggttgtttttttttagggtttttttttttttggttttttgtttattttggtttgtttgggtattagggtattgttttttttgtggttttagtttttttttttgttttagttgttgagtagttttttttttttttttagtttttttattttagttttaagtgatttatttgaggttttaggtttagatgtttaggtagtgatttagtggtatattttttttttttagggttagggtagtagtagttttagagtagtaggtggaagttttagtttagtttggtagggaaagtattggtatagagattttaaataggttttgttaggaggagttttggataatgatatggtaggaggattagattgagaataggttggtttttttttagtggttattgtgtgatttgggggttagtttgagtagtgtatatgaagttaggttttggggtttttagtgtttttttttatattttggtatagttattgagtgttttttgttttttttagtatttgaattttttatgttatttgtttttttattgaggtttattttaagtagaatttggaataaaaattttttatattgagggtgagggataagggagtgtaatgtattgatttttatagttattttttttttttaattaagggtttttatagggttttttttgtttagaaattgtagtgtatttttatggttgttttttaaagttaggtggtatgtttttatttataagtgggagttgaataatgagaatatatggatatagggaagggaatattatatattagggtttgtgggtagttgtggggagaaggatgggggtaaggggagggagagtattaggattaatatttgatgtatgtggggtttaaaatttagatgatgggttgataggtgtagtaaattattatggtatatgtatatttatgtaataaattatattttgtatatgtatgttagaatttaaagtaaaaataaaataaaattaaattaaaattaaaaatttttaaaaagtttggtagtgaggtgttttagatttggtttgttgttgtgtgttttttaaatatattggtatatgtaattagtgtggttaagatttttggtttgtgttgatttttttgtttagaatgtgtttatatatgtttatgttttttattttgttgaaatttaattttttttttaaaggttattgtagggagtttttttagggtttaattggatttagtgtttatttgttttgttttgtataaagtgttttttttgttttttttgtgtgtatttagagaattttgattttgattgaattatttgtgtatttgtttttttttagttttatttttatatggtgagtttattggttttatttatttttgtatgaggtaagggttttgtttatattaggtgttaattagtgtttatggttattatatggtaataggggttattggaggagtgtttaggagtaagggagttttttttattttgtgaaattatattattgattatgttatgaaataattattttttttttggattttaagagtggaattgagataatgggttggaaaagagttttagagagttataaatttttgaggagtgatagtaggaaattgtggtttttaggatttagtgagggagttgagtaaattttttagtgggtagagatggagataggtaggtagatgaagaagataaagagttagttagatggaaaagttagggagaaaaatagagatagtagtagagttgtgggttattagggttagtttttgaaggtttgtttttaattaggtgtttttgttttaggaattgaggttgtgattgtgtttattaaatggttatatatttgagattggtgataattgtatttatttgttattaatttgttgtgtaattttgggtaatttttttttttatggtagggtaggagagttgtatggaatggtttttagagtttgattttaattttatttttatattttttagttgtttataaaggtagagtagttaagatataagtaggttttgtggatatttaaagtagtgattttgttttggtttagttttaggaagttgggtttttatattttgtttattttatttttgggttttaggtgttagaaattttttattagtggttttgtgggattttgtttagttgttttgtgttttttggtggttaaggtgtgttattgtagtgttggttttttgttatttttttttttttgtttgttagattttttggtgttttgtttatgatttaaataggagatagtgttgatttatttttaagtggtttttttatatttatatttgttttatatagatgaggttttttggatagtttttgtttagaagtttaggtggatgtttgagatggtagttagatatttggaagttattttaaaagtttagggatatgggtatttgggagataggaggtggaaagattatttgagtttaggagtttgaggttgtagtgagttatgattgtgttattgtattttagtttggatgatagagtaagattttgttttaattaattaattaatgtaagtttagagataagggtaggagaaaattaggggatagaagtgagggattggttattgttaagttttgtttatttattttttttttttaggttgtttaggggaaagagaaatggttttattgtgggggttataggtttagtttaagttttgatattgtttttggtttattgtgtgattgttgattttggttgagtggtgttatgaatttgagtttaaatgtttttagtagaaggattttttttattatgttttgttttataaaataagttttgaggtattttgttttagtaaaatgtattaaataatttattttttttgttgtattaattggatttataagtgttttttggtagtatgattagtatgtgaggatttatgttattatattgggtttaggttattttggatttgttatttataatgggtgtgtgtatattttttgttggggggtgtagattgaaattttgaagtatttgttgtgtgttaggtgttttttgtatattattttatttaatttatataataattttaggagttggaataagatgattttattttatagaggagaatattgagatttaaagtttgttaaatttatataattagtaaggggtggggaggtatgatgaatataggtggttataatgttaaattttttttagaagttttaattattttttgataattttgagagttttaatattttatttttatttagattagttttagtttttttgtttattttttttttattttatatttagtttatttgttttattttttaattttagtaggtgttagaagtttattttttttttatttttgattttggtattttttttttttgtttttaaatgttttgtggattggattttttttaatttttgtttatttatttatttgagatatagatttattgttgttaaggttggagtatagtggtattattatagtttattgtagttttatgtgatttttttatattaatttttttagtaattggggttataggtgtgtgttattgtgtgtatttttttgtattttttgtggtgatggagttttgttattttgtttagatgggttttgaatttttgagtttaagtaatttttttgttttggttttttaaagtgttgggatattaatgtgagttattatgtttagtttagtttggattaaatataaatataaaagagattgggtatggtggtttatatttgtaattttagtattttgggaggttgaggtaggtagattatttgaagttaagagtttaagattagtttgtttaatatggtaaaattttatttttattaaaaatataaaaattagttaggtgtggtggtataagtttgtagttttagttatttagggaggttgagttaggaaaattgtttgaatttgggaggtagaggttgtagtgatttgagattatgttattgtattttagtttgggtgaaagagtaagatttttttttaaaaataaattaaaaatgaatatgttatttaatttaatatttttattgttaaatatttattttatgttgttatttttttattagtatgtaggtatataaatagatatttgtaagaaggaagaaatggatataagaaaaatttttattaataaaggattgggttgggtatagtggtttatgtttgtaattttaatattttgggaggttagggtaggaggattatttaagtttaggagtttaagattagtatgggtaatataatga

SEQ ID NO: 349 - DNA, 10001 bp, Artificial Sequence
  chemically treated genomic DNA (Homo sapiens)
ttattatattgtttatgttggttttgaatttttaggtttaagtgatttttttgttttggttttttaaagtgttgggattataggtatgagttattatgtttagtttaattttttattgatggaaattttttttatgtttatttttttttttttgtaaatatttgtttgtatatttatatattggtggaaaaataataatataaggtaaatgtttggtagtagaaatattaggttaagtggtatgtttatttttaatttgtttttgagaaaggattttgtttttttatttaggttggagtgtagtggtatgattttgggttattgtaatttttgttttttaggtttaagtgatttttttggtttagtttttttgagtagttgggattataggtttgtgttattatgtttggttaatttttgtatttttagtagagatggggttttgttatgttaggtaggttggttttgaatttttggttttaggtgatttgtttgttttagttttttaaaatgttgggattataggtgtgagttattatgtttagttttttttatatttatatttaatttgggttaggttgggtatggtggtttatgttggtattttagtattttgggaggttgaggtaggaggattgtttgagtttaagagtttaagatttgtttgggtaagatggtaaaattttattattataaaagatgtaaaaagatgtgtatagtggtgtatatttatagttttagttattgaggaggttaatgtgggaggattatatgaggttgtagtgagttgtgatggtgttattgtattttagttttggtgatagtgagtttatgttttaaataagtaagtaaataaaaattaaaaagaatttagtttatagggtatttgaaggtaagaggaaaagatgttagaattagagatggggagaagatgggtttttggtgtttgttgaggttgagaaatgagatagataggttgagtgtggggtggagagaggatgggtagagagattgaggttggtttgaatggaaatgaaatgttagggtttttagggttattggggaataattggagtttttaggaaaggtttaatgttgtgattatttgtgtttgttatgtttttttattttttattaattgtgtgaatttggtagattttgagttttagtgtttttttttgtgaagtggggttattttattttaatttttgggattgttgtgtgaattaaatggggtaatgtatggagagtatttgatgtatagtgagtgttttaaaattttagtttgtattttttagtaaaggatatgtatatgtttattgtgagtgataaatttaggatgatttgaatttaatgtgataatgtgggtttttgtatgttggttatgttgttgggagatatttatggatttaattagtataataggggaaataaattatttaatgtattttgttaagatagaatattttagaatttattttgtggggtggggtataataaagggggtttttttgttgaaaatgtttaagtttaggtttgtggtattatttaattaaggttgatagttatatagtaagttagaggtaatgttaggatttaaattaaatttgtggtttttataatgaggttattttttttttttttgaatggtttggggaaagggggtgggtgggtagaatttggtagtggttaattttttatttttgttttttggtttttttttgtttttatttttaggtttgtattgattgattgattgagatagggttttgttttgttgtttaggttggagtgtagtggtatgattatggtttattgtagttttaaatttttaggtttaagtggtttttttgttttttattttttgagtatttatatttttaggtttttaaaatggtttttaggtatttggttgttgttttagatatttatttgggtttttgggtagggattgtttgggaaattttatttatgtgaagtaggtgtgggtgtaggaaggttgtttggaaatgaattagtattgttttttgtttgagttgtaagtagggtgttagagggtttggtggataagaaagggaggatgataggaggttggtattgtaatgatatgttttagttattagagggtatgaagtagttgggtaaaattttgtggggttgttggtggaaaatttttggtatttggagtttggagatggggtggatggaatgtgaggatttagttttttgaggttgggttggggtagagttattgttttggatgtttgtagggtttgtttgtgttttgattattttgtttttgtagatagttggagaatgtgagagtgggattgggattggattttaggggttattttgtataatttttttgttttgttgtgggggagggagttgtttaaggttatgtagtaagttagtggtaaatgaatatgattattattagttttaggtatatggttatttgatgggtgtagttgtagttttagtttttgagatagagatatttgattaaggataggtttttaggagttgattttagtgatttgtggttttgttgttgtttttgtttttttttttggtttttttatttgattgattttttgttttttttgtttgtttgtttgtttttgtttttgtttgttggggggtttgtttaatttttttattgggttttgggagttgtagttttttgttgttattttttagggatttgtagttttttgaagtttttttttgatttgttgttttggttttatttttgggatttagaggagaggtgattattttgtagtatagttagtggtgtgattttatggggtgagaaggatttttttgtttttaagtatttttttagtgatttttgttgttatgtggtagttgtaagtattggttggtatttggtgtgggtgagatttttattttatgtagaaatgagtaagattggtgagtttattatgtgggggtgaggttgagagaaaataagtatataggtgatttagttaaaattagaattttttaagtatatatgaaaagggtaaaaggggtgttttgtataggatagaataggtagatattgaatttggttgggttttgggaaggttttttgtagtggtttttgaagggggggttggattttagtaggatagagggtatgggtatgtgtgggtatgttttgaatagaggggttagtgtaagttgagggttttggttatattagttgtatgtgttggtgtgtttaagggatatgtagtagtaggttgagtttggagtgttttattgttaggttttttaaaaatttttaattttaatttaattttattttatttttattttaagttttggtatatatgtgtagaatgtggtttgttatataggtatatatgtgttatggtggtttgttgtatttattaatttattatttaggttttaagttttgtatgtattaggtattagttttaatgttttttttttttttgtttttatttttttttttgtaattgtttataggttttggtatgtggtgtttttttttttgtgtttatatgtttttattgtttaatttttatttatgagtgagaatatattgtttggttttaagggatagttatggggatgtattgtagtttttgagtagggaaggttttgtggaggtttttagttaaaaggaaagaatggttgtgaaaattgatgtattgtgtttttttgttttttatttttagtgtgaagggtttttattttgagttttatttgaagtaggttttgatgggaagataagtagtatgaggggtttaagtattgaggggagtaagggatatttggtggttgtgttaaggtgtagaagaggatattgggggttttaaggtttgattttatgtatattgtttaggttggtttttaagttatatggtgattgttaggaagggattagtttgtttttagtttgatttttttgttatgttattatttaaagttttttttggtagggtttgtttggggtttttgtgttagtgttttttttgttaggttgggttggggtttttatttattgttttgggattgttgttgttttggttttgggggaggagggtgtgttgttgagttattgtttgggtatttgggtttggaattttgggtgagttatttagggttgaggtagaggggttgggggaggggaagaagttatttgatagttggagtagggaggggagttggggttataggaagggtggtgttttgatgtttagatgggttgggatagataaagggttaaggaggaaggggttttgggagggggtagtttttttttgggttgggttttgaatggttatagtgtttgtttttttttgggtttggggaggatatgtgtgtggggggtagtgagagagggttgtggttgagggttgtgttttaggtttggattttggtttgggaagttgtttagttggtgtttttagttttgggtagggatgtatttttatttatttatttagtttttaagttggagaagaggaggttaaagtttttttgtttagtttttaattatttgggatttttttatgttttttatagattgtggtttagtttaattgtggttgtgtgtagagtaattttattttttattgtttttttatttttttagatatttttttatatagagggatttttttaggtatttttaagtatatttagttattttattattttattaagaggtattttggtgttggttattaaaagttattttattttatttatgttttgaagttagttttgtttttttttttttgatgttttttagttgttttttttggtttttagttttttaagggtggttttaggttgttttttttttatatatataggtgtatgtatgtatatgagtattggattatgaagttttagtgtgtgtttatagttttttatataggagtgggttgtgatttataggtatgttatgagaatgaggtttggtattagtttttaggttttagagtaggggttgtttttttttattttggtttaggatgtttagtttttatgatattttttattttttattgtggtttgggtgggtttaggggttgtttttgatttggtttagagtttttttttagttggtggtggagttggtattttttgggagggagggggttgggagggaatgagtgggaatggtaagaggttagggtttggtgggattaggttgaggtaggtttggtttttttaaaatgttaagttgggggttagtggggtttatatataaatttttattttgggagtttggttgttttgtttttttttttgggtttgtttttgttatttggtttggtgagtatttttgttttgttgagggtagggtggggaggatttttgtgggtttttgtttttgtttttatagtttttttattttagtttttttggtgggattaatttgggtttttttgggtttttttttttggaagaattttttgtgaagtgttgaagtgttgattgaagggttttttttttttttttttttttttgagatggagttttgttttgttgtttaggttggagtatagtggtgtgattttagtttattgtaaatttttttttttaggtttatgttatttttttgttttagttttttgagtagttgggattgtaggtgtttattattatgtttggttaatttttttgtatttttagtagagatggggttttattatgttagttaggatggttttgattttttgattttgtgatttatttattttggttttttaaagtgttgggattataggagtaagttattgtgtttggttgattgaagggtttttttttaggtttttttgtgaggttttagtgtaggggttgttttgaggtttttttttggatattttagtttaggggtttttttttgggggtttaggtttaggagtaggaggtgtgtatgtgggtgttgttgtaaaaagaattttgagatttttttttttttttttttttttttttgtaaagttttggattttagtaggattaaggtgtaagaggtaggggttttaagattttgtttgggttatggttttaagtagtaaagttttgttttttgttttggtgaaggtagggttggtatgatgggtttagggtatgttttgtttttggtatagtttttttggttttattttgaaatttgtttaatttttttaggttggtttgagtatttttagaggttttgttgttgaggtttgttttattttgattttaaggtaatgaatattttatatttttaattttaattttaataggattttttttggtggagagaatgttaagttgtttttattttatttatgtttttgtttgtttagaggtttaggggtttttagggtgaggggagatatattttttattttttgggagtttttagtttgagagaggaaatatttttgtttaagggagtttttagttagatggtagagagagatgtttttggttttaggagttttgagtttaaggagggaaatgatttttttagggagttttttgtttttaggttgtagttatggtttttgttagattgtataggagtttttatttgttagttggtgtatgtggttttgttttttagagtttgtgtagatgttattaaaatgggattttggttattttgttattttttttttggtagatattaaaatggggagttttgtttttaggggggtgttttaagtgttattagaggaggtttggtgatttttagatataagggaagttttagtgtttgtttttagggtgagatggaggtattgtttttggttttagggaattatagtttgagggggagatgtagtttttgtttttttatttagagaggggttttgtgaggtggtttgggggtatagggtagaagtggattttataggttgagttaaggttttaagagttttagtagtgtatttattatttggtatttttgtagttatagatttatgatgtgtagttttttggagtaggtgttggttgtgttggttattattttttataagtatttttgttaagagggtgataagtttaagttgagtaagggggaaatgaaggaatttttgtataaggagttgtttagttttgtgggggtgagtggtataggtttgtgggggaggttttggtgtgagtgtgggggtgtaggttaaattttttttttagttttgggtgtttgttgatgtaggtgttagggtggggtttagttttttttttattttagttttatggttttattggagtggaaatgaggtttgagtgggagtgtttaattaatggttgttttttgtagtattttagagaattatgtgttgtgagggttttttgagtttatttgtttaattttgttattggagatttgagaaattagagtttagaagggaaaagtgattgttttaagattatatagtattggtatgtttttttttttttttttttttttttttttttttttttgagatggagttttttttttgttgtttaggttggagtgtaatggtatgattttggtttattgtaatttttgtttttaggggttaagtaatttttttgttttagttttttgagtagttgggattataggtgtattttattatgtttagttaatttttgtatttttagtagagatagggttttattatattggttaggttggttttgaatttttgattttgtgatttatttgttttggttttttaagtgatttttgtatttttagtagagatggggttttattatattggttaggttggttttgaatttttgattttaggtgatttgttttttttggtttttgaaagtgttgggtttataggtgtgagttattgtgtttggattttttttttttttttttttttttgtggtggggggataagattttattttgttatttaggttggattatagtttattgtaattttgaatttttgggtttaagtaatttttttaagtagttggaattataggagtattgttattatgtttggttaatttttatttttgtagagatggagttttgttatgttgtttaggttgggtttgaatttttgggtttaagtaatttttttattttggttttttaaagtattggaattatagatgtgaggtattgtgtttgatttttttttatttttatatgttaaattaagaaagtatgtagggatagaaaagtttagttaagatatatagtttgggatattttgtggagaaatgtattgatttttaatttgttttttattttttttatattgatttattggtgatttttaaagttaggtgttaggttttgaatatatgaggtaggttttttttttttttttttaattttgtttttgtggttggttaaatttttttaattattttggttagtattaaaaaagtgttttttagttgggtgtagtggtttatgtttgtaatttttatagtgtgggaggttaaggtaggaggattttttaagtttaggagtttgattagtttgggtaatatagtaagattttatttttataaaaataaaaataaaaattggttaggtatggtggtatatgtttgtagttttagttatttgggtggattgtttgagtttaggagtttaaggttatagtgagttataatatagtttgggtgataaagtgagattattttggttgttaagattagtttaggtaatatagtgaggttttgtttttattaaaaataaataattagttgggtgtggtggtatgagtttgtggttttagttatttgggaggttgaggtgggaggattgttggagtttaggaggttgaggttgtagtgagttgtgattgtgttattgtattttagtttgggtaatagagtaagattttgttttaaaaaataaaaagtgtttttttttgaatttatttggttggtgttggggagtagtaatttttggtttttttattagtagaatggggtgatgatatttattttgttgggtttttgtgggatttgagttgatgtatgtttagaggagtatttagtgttttttttgtgtttaggaggagggtatattggagatgtttattaatgagtatttgtttttttttttatttattgggtttttttggtagtttttagggttttttgtttattttatatttagttgtttagtggggagggagagttgggaattaatttgaatgtgtgagggtttgggtgtttggtggagttggggttggggttggtttggtgatgagtgtattttttgttatttttaggagaaagtggatgaggaggggttgaagaagttgatgggtagtttggatgagaatagtgattagtaggtggatttttaggagtatgttgtttttttggtatttattattgttatgtgtaatgattttttttagggttgtttagattgattttgaagtagaatttttgattttttgttatggattttttgggtttaggattgttgatgtttttgagttttgtatttaataaattttttttgtttgttgataatattttaattgtttagtgatgttttataatttggttggtttagttggagtgttgggagatgagggttttttggattttgtttttttttgggttttgatttttttggaaatttttttaaggttagagttatgttttaggttttaattttggaattttaaatattagtaaaaaattggaaattgagataggttgttgatttttattttgttaaataaagatattaaaaaaggtaaatattatttattattattattattttataaaaagataaaattttaattttaataaaggaggaaaggtataattttagaataaaggatagattttaatatttaatattgtaagtaatgagttgtattaggatttatttaagagatatgaattagtttaattgattttgtaaagttttatttaaaagattttttgttagattgagtatggtggtttatatttgtaattttagtatgttgggaggttaaggtaggtagattttttga

SEQ ID NO: 350 - DNA, 4449 bp, Artificial Sequence
  chemically treated genomic DNA (Homo sapiens)
ttttttgtatatttgagaggtaagaggaggtgtttgtggtttttttgatatatatgtgatatatgtattattatggtttatgtgtgtgttgttgtgtgtagggggtagggggttttttgtttttgatggttttttttggtgggtgttttttggttttttaggtttttttatttgttgaatgtggtagttaagggtttgggaatgatttgttagattggttaatgtggaaagagttggttttgtttagttttgtatttttttttttttttttggaattgtttggttgtagagagtaggagttttttagagtttttgggggattttatttttagtataattgtgtaatgtgtgtttagtataagagtattagatggagggataggtgggaggaggaggaatttagggtgtatttagtttggggtttgttgagttgaggtttttagagtaaggatgattaggttggggggatatttttttttaatttttgttaagttatagaggggttagtgggaataaagtgatattttggtttttgtattttttttttgttgttttattttttagtttgtttagatttgaggttggggaggggtttttttggaggggttagtttatgttattttttgtaatttttattatatatgtttttagatattttgttataggttttattttttatgttaatttttatttgggaaagtaaataaatggaaagttaatttgtgttatttggttgttggggtatttgtagtgagtagttaagaaatgttaggggagttggtgtttatttttatgtttggataagagtgtgttttggatttgtgttttgttgtatattttattgttttgttgtatattttattgttttattgtatattttattgttttattgtatattttattgttttattgtatattttattgttttattgtatattttattgttttattgtatattttattatttttgttttttgtatttagttgtttatttgtattttagtttaggaagtttagaagatgtagaatttttgtgagagtttagggtgaaatgttgtgttttatttttaaagaaaggaaaattatttatattttttaaaagaatgaatagtatagattaatattgattttttttaatttttaggttaattttgagtagttaaagttagagtagttaatttgtgttgtgagttgaggtatagttgtagaagtgtgtttgaggtgtttggtggaggtggtagttgagttttgggattaattattgtgttggggatggtattgtgttaggatgtaggtagatttttgtagaagtgtttaaaatttatatttttttataggggtgagggggagggagaaagagatgttttagtgaggataaatatttttttttatatttaaataattatagagtttttattttaaagtatttataggtatattttttagaaaatatgaattgttagttgggtatggtggtttatgtttgtaattttagttttttgggaggttgaggtgggtagattatttgaggttaagagtttaagattggtttggttaatatggtgaaattttgtttatattaaaaatataaaaaaaatttagttgggtgtagtggtatatatttgtaattttagttattaggaagttgaggttgaatttaggaggtagagattgtagtgagttaagattgtattattgtattttagtttaggggtaatggagtgagattttattttaaaaaaaaaaaaaaaaaaagaatatatgaaatgtttttagattttgttatgttttttttttttattttaggtaagttagaaagtgttattaatagtggttttttttaggtttttggttagagatgtgaagagaagttggggggaaattaggtttttttttaagttttttagttttgtttttttatttttggatttgaatgtagtttgatttaggttattttattgtattattattggtggttgtgattttgtgtaaaggtatagttggtgatgttgattagagtttttgtagttttaaatgatttttttaattaattttaaatttttagaatttattgtataaaaaggttatattttttggagggatgttgatggtattaggatagaagtattaggggattttatgaatggtgttgttgaaatagtagtttttatttgtatattgggagggtgtgatattaggaaaattataattttgttttttatggggggttattgtatatgtttttgaaagtgtataggtaagaagtaaagtaagttgtgggttgaattttttgatgttattatgtatatatttatttagtttttttttttaatgatattagtaattgtttagtgaggtggatataaaatttttaggatatgagagggagatgtggtttttatattttgatgtgtaaatattatgtttagggaaaatgtaaggtgttttaggtttgtggattttgtatttttttaggtaatttatttatttattttttaattttaataaatgattattaaattttatttaatatataaatatttattgagtattatttgtgtgtatgagaagtgggagttagtatggtaaaagttaggtattgtgttaggtgagagagatttagaaattaaaattagagaagttattaataagagtttaaatatttgggtttaggtttatgtttgtaattttagtattttgggaggttgaaggaggtgaattatttgaggttaggagtttaagattagtttgattaaaatggtgaagttttatttttattaaaaatataaaaaattaggtgggtattgtggtatatgtttgtaattttagttatttgggaggttgaggtaggagaattatttgaatttaggaggtagaggttgtagtgagttaagattgtattattgtattttagtttgagtgatagagtaagattttattttaaaaaaaaaaaaaaaagagtttaaggatttgatggaggagaaaggtaagaatatgtgtgagataatgtaaggttattgttttagggtgtttagggtaattatgggggtagggtattttttggagaggttaatgataagtaggttgaataaagtaggggggttttttgtaggaggaggtttattaggtgaagatggagttgtatgggtaaaggttattttagagatttaggtgtgtttaggaggtggaaatttattgtaggtaaggtgagaggattgggtggggtggtttaggaggagttgatagagggtataagttgtgaaatagtttgaagtagggtagtgaggaaagggatttagaggaggaagatatgtggatagatggggttggttgggggttgttgtaggattttatgtaagaggttttaatattagagttttaggttttgagttttgtggaattaaaggttttagaaagtaatttattaggatttggtggttgatagtttgtagtagggggtgaaagaggagtttagagtattttttggtttttgtttttgttttggggtataggaggggaggaatttagtttggttatattggtttaggtgagggtgttttaggggaggttgagaggggttgtttttttgtttgttttgttattagggattgttttgagatgtttttggagaaagtgtttttggtttgttgggaaggatttgtgtttagtttttgttgtttagtagtttttatgggaattttgtttttttggggtttggatttattgtgatgtgaaggtgattattgtttatttttgggatattgtgggggttaagagaggttttgtggtgagggaggattattattttgggggttgggggggttttttttttagggaggaagatttttagttttggtgttttgtttttggtagattttgttttgtttatttgttttgtttttgttgtatgatggaaataaatggaaatggtttttatatatgaatgtattaaattgtaattataattttttagattttagttgtaataggattatggatttgagtgatttgtaaagatgttttgagttttgagttagagggtgtgtggggtggggaggggagtttgttatggtttttgtgattttatagtatagggggtagagttgggggttggggtgggggtaagggtgtaggtagatgggtttgggggtggttagtatggggatttatttagtttgttttgtatattgaggttatttttttttttgggttttaaagtttttttgttttttgttatgggtttgggggtttttttattgtagtttaatgttggttgtttttttatgttgtttaagtttattttttaggtttggtattttatagtagagattaagaggtggttggagggtagtgggggtatggatagtattattgggtgttttttttttaggtttttttggaaatttttgttttggaaatgtagaaagtttttttttttgtttttatttt

SEQ ID NO: 351 - DNA, 4449 bp, Artificial Sequence
  chemically treated genomic DNA (Homo sapiens)
aaggtgggggtaggagaaagggttttttatgtttttaaagtaagggtttttagagaggtttgaagagggagtgtttagtggtgttgtttgtgtttttattgttttttagttattttttgatttttgttgtggggtattgggtttgaggggtgggtttgggtagtgtagaagagtagttagtattgggttgtagtgggaagatttttaagtttatggtagggagtgggggagttttggaatttgagagaggaagtggttttggtgtatagaatgaattgggtgggtttttgtgttggttatttttaggtttatttgtttgtgtttttgtttttattttagtttttagttttgttttttgtgttgtgggattatagaggttgtggtaaatttttttttttattttatatattttttggtttaaggtttagagtgtttttgtgggttatttaggtttatgattttgttataattgaaatttagaaaattgtgattatagtttagtgtatttgtgtgtggaaattatttttatttatttttattatgtgataaagataaagtgggtgggtaagatagagtttgttggaggtagagtattggggttggaaatttttttttttgaggaggaaatttttttgatttttaggatgatgatttttttttattatggggttttttttgatttttatagtgttttgggggtgggtgatgattatttttatgttgtgatggatttagattttaggagggtaaggtttttatggaagttgttgggtagtgggagttgaatatggattttttttagtaagttaggaatattttttttaaagatattttgaggtagtttttgatagtaaagtagataagagaatagttttttttggttttttttggggtgtttttatttgagttagtgtggttagattgagtttttttttttttatgttttaaggtagggatagggattggagggtgttttgggttttttttttattttttgttgtaggttgttaattattagattttaataggttgttttttgagatttttgattttgtggagtttagagtttgaagttttggtgttagaattttttgtataagattttgtggtagtttttagttagttttatttgtttatgtgttttttttttttagatttttttttttattgttttgttttaagttgttttatagtttgtattttttgttggttttttttagattattttatttggtttttttattttatttgtaatgggtttttattttttgaatatatttgggtttttggaatggtttttgtttatgtggttttatttttatttggtgaatttttttttgtagggagtttttttgttttgtttaatttgtttgttattggtttttttggggagtgttttatttttgtggttattttgggtattttgggatgatggttttgtgttgttttgtatatgtttttgttttttttttttattagatttttagatttttttttttttttttttgagatggagttttgttttgttatttaggttggagtgtaatggtgtgattttggtttattataatttttgttttttgggtttaagtgatttttttgttttagttttttaagtagttgggattatagatgtgtgttataatgtttgtttaattttttgtatttttagtagagatggggttttattattttggttaggttggttttgaatttttgattttaagtgatttattttttttagttttttaaagtgttgggattataggtatgagtttgggtttagatatttagatttttattaatgatttttttggttttaatttttgggttttttttatttggtatagtgtttggtttttgttatgttagtttttattttttatgtatataaatggtgtttagtaaatatttatgtattgagtaaaatttaataattatttgttgaaattaaaaagtgaataaataagttatttagaaagatgtaaagtttataaatttggggtattttgtattttttttgagtgtaatgtttgtatattaggatgtgaggattatgttttttttttatgttttgagggttttatatttgttttattggatagttgttgatgttattggagaaggaagttggatgggtgtgtgtatgataatattaaggaatttagtttataatttattttgttttttatttgtgtatttttagagatgtgtatagtggttttttgtgaaagatagaattgtggtttttttggtgttatgtttttttagtgtgtaaataagggttgttgttttgatgatattgtttgtggggttttttggtgtttttattttaatattattgatgtttttttagaaggtatggtttttttatatgatgggttttgaagatttagaattagttagaaaagttatttaagattatagaggttttgattagtattattagttatgtttttatatagagttatggttgttagtggtggtgtaatggggtagtttgagttaggttgtatttaggtttaggaatagaaaggtagggttaagggatttgggaagaaatttgatttttttttggtttttttttatatttttaattaaaagtttgggaagagttattgttggtaatgttttttagtttgtttaggatagagggggaaggtatgatgaaatttgaagatattttatgtattttttttttttttttttttttgaaatggagttttgttttgttgtttttgagttggagtgtaatggtgtgattttggtttattgtaatttttgttttttgagtttaattttagttttttagtagttgagattataggtgtgtgttattatgtttagttaaattttttttgtatttttagtatagatggggttttattatgttggttagattggttttgaatttttgattttaggtgatttgtttgttttagttttttagagagttgggattataggtgtgagttattgtgtttggttgatagtttatgttttttaaagaatgtgtttatggatattttaaagtaaaaattttgtaattgtttaaatgtgaaagaaaatgtttatttttattaaagtattttttttttttttttttttatttttgtagaggagtgtgaattttagatatttttgtagggatttgtttgtattttgatgtggtgttgtttttagtatggtgattagttttagagtttggttgttatttttattggatattttagatatgtttttgtagttgtgttttggtttataatatagattgattgttttgattttgattatttaaaattggtttaaaaattaaaagagattgatattaatttgtgttgtttatttttttaaagaatatgaatgatttttttttttttgaaagtgaagtgtagtgttttattttgggtttttgtagaggttttgtattttttgggttttttgagttgggatataagtgggtagttgagtgtagaaagtagggatggtggggtgtatagtaggatagtggggtgtgtagtaggatagtggggtgtgtagtaggatggtggggtgtatagtaggatagtggggtgtgtagtaggatggtggggtgtgtagtgggatggtggggtgtgtagtaggatgtaagtttaagatgtatttttgtttaggtatgaaaatggatattgatttttttggtattttttaattatttattgtggatgttttagtgattaagtgatataagttagttttttgtttatttgtttttttaaatagaaattggtgtaggagatgaaatttgtagtagaatgtttgaaagtatgtgtaataaaaattgtagagggtggtatggattgatttttttaggaaaatttttttttaattttagatttgaatgaattagaaaatagaatagtagaggagggatatagaagttaaaatgttattttatttttattggtttttttgtagtttggtaaggattgggagagggtgtttttttaatttagttgtttttgttttggggattttagtttagtaagttttaagttaaatgtattttgggttttttttttttttatttgtttttttatttggtgtttttgtgttgggtatatgttgtatagttatattggagatgggattttttgggagttttggaaagtttttgttttttgtagttagatggttttagggaggaagagggaggtgtagaattgagtggggttagttttttttatattaattagtttggtaaattatttttaaatttttggttattatgtttagtagataaagaggtttgagaggttgggagatatttattaagaagaattattaggaatgggaagttttttgttttttgtatatagtagtatatatatgagttgtaataatatatatgttatgtatgtgttaggggggttatagatatttttttttattttttagatgtgtaaggaa

SEQ ID NO: 352 - DNA, 4296 bp, Artificial Sequence
  chemically treated genomic DNA (Homo sapiens)
agaaatttatatatttttttatttttaagaaaaggaagtagtggtgatattatttttggttaaaatgtagtttgtttatattttaaatatttggtaataatgttttttttagagttatgaagtaattagaataattaaatataatttttttttaaatttttattgtttgatttatttatttatttaataaatatttattaaatattgattatgtgtttgatgtttagggatataatagtaagtggagggaaagatatataatatttgtttttaagaaatttggagttgagtggaggatagaaatataaattaaagaatgatataaataattataaagttatagttgttaaaagaaaagtatatggtgttaagagaatgtgtaatataagatttatttatggaggtgagggaaagtttgtttattaaagaagttatgatttaatttatgaagattaggagttggttgggtgaagaaaaaaaggttagaggaaggaagtttatattggggaaggttttaagtataaagggtaggaggattatagaggtatatttatgaaatttggagaaggtttttagtaagtaaggagaagttaaatgaaagtttatgggagagttggaggtttgaagatatgtttaaggatttggtttttattttttttttattttaagagtagtgggaagttattaaatgattttaattagagggttggtataattagttttgtattttgaaaagttgaatttagtttttgtttgagaaattgagtgaaagagtttagaatggttgtggttgagggtgatttgtgggagatttttatataagttatggtagtggtatgggttggtggtagaagagggaatagggagaagatttggaatttaatttttttttattgataaagttattttagttttggtaaggtaattaattggtgggaaagaagatgtttagtttttttgattttattgtattttttgtatttttaatatgagtattgggaagtggtaaaatatttagaggtagtttgggtgttaggtggagtatgagttaaaattttaggatgaagtaaatgaatatttagaatgataggaaagatttgggagttgggtttgggggagggttatttatttttattttttggagattttggtataaatttttgtttttgtaattttttttttaggtaaaggaatttattaaatgaattgttagaagatttattgattagagggttgtatagaattatatttttgagagtgggaagtaggttgattatatagtttattatttaattaggatatatttgaaagagaaagggggttttattaatatttaaattataaaatatgtatattaggaatgttttgggtaaatttggttgttttagtaagaaaggaaatttgaaagtttatattgttttgtttttatgttattttgtttgtatatgagagggtaagtattttttttttttatttgtattaagggaataaaagtataagtatttaggtgatttttaatttatttttaattttatagtttttgttatattttatatattttgaaaattatattttttattattattattttgtgataggtgattatttataattatttattgatttagttttgggaagaggtggtgtaaaatgggatgttttatttaggtgtttattagaaatgtagaatttttgtttgttttttagatttattgaattagaatttgtatttttaaataagatttttaggtgattaatatgtatattaaaatttgagaaaaatttttagattttgatttaaagaaaaatattttataatttgatagtgtatgtatatatatatatgtatatagatataattgaagtataaatttaatgaagtagaatttattgttattattttatttgggaaagaaatgtgtttgtgatttaatagattggagtatttatttttggattttaatttgtaatttgaaaatgtatttttaaagtatttaggagtaatttgaagaaagttgaggggaggtggtagatgttttgatttattagggaaaatgtggatgttttttgttgttattttgtgaattgtgtgtatttagttatttttgagtaaatatttggagtgaggaatttttgagtggtgtgggagggtggtgaggggtagttgaaagttggttaaagtttttggaggggttggtttaggaaatatgattggtagttatgagagagttaggggttggatgttgaggagagggagaaggtttttgggtggagagaggttttgtttagttgttggtgaggagttttttgttttttttgtagtgttgagttgaagttgagtgagttatttgtgtgtatggagtgatgatatttttgtgtgtgtatttgtttgggataggagttggatttttgtgtagttttttttggttgttgggggtttttttgtgttttgttggtttttaggtttttttttggttggtgagtgggtgttatatttggtttgtatatttgtgttgttggtttggtgtggggtttggagagggtgtggtgtggaggtgtagttaggggtttgggaaggtgttgtttgttgtgttgggggtttggtttatgatgagtagtggggtttgttatgggttgggggttgtttaggggtttgtggttgttgtatattgttttgtggatgtgtattgttagtatgattttattgtatgtttagaagttgggtgagtggtttttagtttgggtttggtggggtgttgggggtttttttggggtttttgtttttttgttgtgtttgatagttgggtttggtaatttggtttttgggtggaaatgaggaaagttttttttgtgatatttatgtagtttgatttttgtagttgtagggattgtgagttttttttgaaaaagagaaggaaagtttagttgtaaggggtgtggggtatgtttggttttttttgtgtgagtaggaaaggtgttgtgttggttgtgtttgaggtgagtttttatttttggaaagggaagtttgagaagttggttatttgaaggtggttggggagtagtggtttggagtggtagtttgagttgttaaagtagttagtgtatttgggttattttgtttatggtgatgttgtgtgtttatttagttttttttgagttatttgtttaaaaggttagttttttagtttttagtttttggagatggttatgtttttttttaggttggttttttggtttggagtttttggaaataagttttaagaaaataattgatttttaaaagaaagttagttggttttattgatgttttggtatggatggatagggagtggagatgtttaggtgaaattgagaattttttattgaatgtttattgggtgttagaggttgtagattttgtttggaataagatagttttgtttttagggagttgatggttttatgtaattattgtttgttggaaattgaagggttaaaattttaattaggttatttatttgattgttgtttttgaaggtttttaaggaaaaaataaaaataaaaaaatatatatatatattatatatatataaatatatatataattatatatataaatatatataatattaatatatatatgtatgtaggaatgggggtttttaattatttgttatggaaagtgtaaaatttttgagattttaaaagttagattttttttttttggagatggagttttgttttgttattaggttggagtgtagtggtgtaattttggtttattgtaattttgtttttgggtttaagtgatttttttgttttagttttttgagtagttgggattataggtgtgtgttattatgtttagttaatttttgtatttttagtagagatggggttttattatattggttagggtggttttgattttttgattttgtgatttgtttattttggttttttaaagtgttgggattataggtgtgagttattgtgtttggttaaaagttagattttttgtagttatgatttaaataatagtatttgtagttgtggtttgggtaattgagtatttgggtaagttatagagttttttttgggttttagtttttttatttgtaaaatggttagtttgaatttgggtaattttatattatttttatgtttaatattttatgtattgtgttttttttttttttttttttggtttttttggtgatttggagatgatttatgtagattttggatgaaatgtagaggagttgatagtttatattatttggaggtatttattttatttatttagggatatgggta

SEQ ID NO: 353 - DNA, 4296 bp, Artificial Sequence
  chemically treated genomic DNA (Homo sapiens)
tgtttatgtttttggataaataaaatgagtgtttttgggtgatgtggattgttaatttttttatattttatttaaagtttatatgggttatttttaagttattagaagagttaggggaaaggaggggaggggtatgatatgtaagatgttaaatatgaagatgatgtaaaattatttagatttaagttggttattttatagatgaggaaattaaggtttagaaaaagttttatgatttgtttaaatatttggttatttagattatagttgtagatattgttatttggattatagttgtaaaaagtttaatttttggttgggtgtggtggtttatgtttgtaattttagtattttgggaggttaaggtgggtggattatgaggttaagagattgagattattttggttaatatggtgaaattttgtttttattaaaaatataaaaattagttgggtgtggtggtatgtgtttgtaattttagttatttgggaggttaaggtaggagaattgtttgaatttagaggtaaagttgtagtgagttgagattgtgttattgtattttagtttggtgatagagtgagattttgtttttaaaaaaaaaaaatttaatttttgaagttttagaggttttatattttttataataaatagttaagaatttttatttttgtatgtatatatatattaatattatatatatttatatatataattatatatatatttatatatatataatatatatatatatttttttatttttattttttttttaaaaatttttagagatagtgattaggtgggtagtttagttaggattttaattttttggtttttaataaatgataattgtatagaattattaattttttgaagataggattattttgttttaggtaaaatttatagtttttagtatttagtaggtatttagtgagggatttttggttttatttgagtatttttattttttatttatttatgttaaggtgttagtggagttagttaatttttttttggaaattgattatttttttgaaatttgtttttaaaaattttgggttaagaagttggtttgagggaaagtgtggttgtttttaggagttaaggattgaggagttggttttttgaatgggtggtttagaaagagttgggtgggtatgtggtattgttatgggtggagtggtttaggtgtgttggttgttttggtagtttaggttgttgttttgggttgttgttttttggttgtttttagataattaattttttaaatttttttttttgggggtgggggtttgttttgaatgtggttaatataatgttttttttgtttgtataaaggggattaaatgtgttttgtgttttttgtaattgaatttttttttttttttttaagaaaaatttataatttttgtagttatgggagttgggttgtgtgagtgttgtgggggaaattttttttgtttttgtttgggggttgggttgttgggtttgattgttaagtgtagtggagaggtggggattttaggaagatttttggtgttttgttgagtttgggttggggattatttatttgatttttgaatgtgtggtgggattgtgttggtgatatgtgtttataggatgatgtgtagtggttataggtttttgagtagtttttgatttatggtagattttgttgtttgttatagattgagtttttagtgtagtggatggtgtttttttggatttttggttgtgtttttgtgttgtgttttttttggattttgtgttgggttggtagtgtagatgtgtgggttagatgtggtgtttgtttgttagttaggagggggtttggaggttggtgaggtgtggggaggtttttggtggttgagggaagttgtataggagtttggtttttgttttgagtgggtgtatgtgtgggggtgttgttgttttgtgtgtgtgagtgatttatttaattttaatttagtgttgtgggggaaataggaaattttttgttaatagttgggtaggatttttttttgtttgagagttttttttttttttttgatgtttagtttttagtttttttgtagttgttaattatgttttttagattagtttttttgagagttttggttgatttttagttgttttttattgtttttttatattatttaggagttttttgttttaagtatttatttaagaatgattaagtgtatatagtttataaagtaataatagaaaatgtttatgttttttttagtagattagaatatttgttgtttttttttagttttttttagattgtttttaggtgttttagagatgtgtttttaaattgtaagttgagatttaggagtgaatattttaatttattgagttgtgagtatattttttttttaaataaaatagtaatggtaaattttattttattaaatttgtgttttagttgtgtttatatgtatgtatgtatgtgtatatattgttaagttgtaaaatgtttttttttaggttgaagtttagaggttttttttaagttttaatgtatatattgattatttggaaattttatttaaaaatgtagattttaatttagtaggtttaggaggtaggtagagattttgtatttttaatgagtatttggatagagtgttttattttgtattgtttttttttgggattgagttagtgagtaattgtaaatgattatttattatgaagtgatagtggtgggaaatgtaatttttagaatgtatagagtatagtagaaattgtaaaattaaaagtgggttgggagttatttgaatgtttgtgtttttatttttttaatgtaggtgaagaaagagaatatttatttttttatgtgtaaatggggtaatatgggagtagaatagtataaatttttaaatttttttttttgttagggtaattagatttgtttaagatatttttggtgtatatgttttgtagtttaaatattaatagaatttttttttttttttagatatgttttgattggataataaattatgtgattaatttattttttatttttaaagatatgattttgtatagttttttggttagtagattttttagtaatttatttaatgaatttttttatttgagaggaagattgtagaggtaagggtttgtgttagggtttttagggaataaaggtaaatagtttttttttaaatttaatttttaaattttttttgttattttaagtgtttatttgttttattttggaattttaatttatgttttatttagtatttaagttgtttttggatgttttgttattttttagtatttatgttgaagatgtagaaagtgtagtgaaattaggagggttaggtatttttttttttattaattaattgttttgttaaagttggagtgattttgttaatggaggaagattgagttttaaattttttttttatttttttttttgttattagtttatgttattgttatggtttgtgtaggagttttttatgagttatttttagttatggttgttttgggtttttttatttagttttttaaatgagagttgaatttagttttttaaaatataaaattagttatattaattttttgattaaaattatttaatggttttttattgtttttgagataaagagaagataaaaattagatttttgaatgtgtttttaagtttttaatttttttgtaaatttttatttggtttttttttgtttattgaaagttttttttaaattttgtgaatatgtttttgtaatttttttattttttatgtttagagttttttttagtgtggattttttttttttgatttttttttttttatttagttaatttttggtttttgtggattgaattataatttttttgatgggtaagtttttttttatttttatgagtagattttgtattatatgtttttttggtattatatgttttttttttaatagttgtaattttataattatttgtgttattttttaatttatatttttattttttatttaattttaaattttttgagggtaggtattatgtatttttttttttatttattattgtgtttttaagtattaaatatataattgatgtttaataaatatttgttggatgaatgaatgaattaggtaataaagatttagaagaaaattgtatttgattgttttagttgttttataattttggagaaaatattgttattgaatatttgagatataaatagattatattttagttgagaatgatgttattattattttttttttttaagaatggagaagtatgtgggttttt

SEQ ID NO: 354 - DNA, 4001 bp, Artificial Sequence
  chemically treated genomic DNA (Homo sapiens)
atgtttagttaatttttgtattttttagtagagatggggatttattatgttggttatgttggtttggaatttttatttttaagtaatttgtttgttttggttttttaaagtgtaggtgtgagttatagtgtttagtttgattttattttatatgaagttttttaataggtaaaatggttatggagattaaaataaaggtggggttgggaattgattgggaagagatgtgatgaaatgtttttgggatgatgaaaagggtttgtgatttggtaggtattatggagtggttaggggttaaaatttatttttttgtgtatttgttgtgtgtattggtgttgtgtgtaaatgttattttgatttaggaaaaagatgatgtaagtatggtataaagtggttggtatgtggtaggtgtatgggaagaaattgtggaatgaaataattgtgagttaagagatggggtagtgggagaaatgaatttgagttttgttttttattaggaagaattggtttgggttggagggttgtatggaggattatatggatgtttgtgggtttgttttttttgttttatgatgtttagtttgtgtttggaattggaatggtttagtttaaagttagataataggtagattgtttttttgataaattattaaatgatttattattgtatttttttaaaatttgatttttagatgtatttatttttttttttttttttttgggaagatgagatatatttatttttgaaaatatttttgggtttgttttttgtatatttttttttttttttgttttatgttatggtagtgtttgtttaggttgtaggtgatttgtggggtggggtatattatttaaagaaggggagggattgaggtttgtattaaaataaatatttttgtttttgtaaaggttataattaagtaatttagaaaaagaaatgtaggtggagaatagtagtttttttttgttaagtaagaggaattggtttaaaggatatttttttttttttttttttttttttattgggtgaatagtgagttgttttggtaaaaagaaattggaaatgttgttgtaagaggtagaaatgtaaatgtggagttaaataataatagggttgttgggttttttagattgtgatggttttttttggtttggtgggtaaatttttggtttagtattttttatttttatgattgatagtttttaattggattttttttatttagtggagttgggggttgtttggaaagattgttttaggaaggataaaggtttggaagttgtgggattttagtagtttgggttttttggattatttttaaatgattattttggaatggagttttagtttttattaggatgttatgggttttaaaatatatagttatgagtttttaatgttttgagatttaaaagttttagattttaatgttttgtgtattttttattttagggattttttatgtttagtattgggtggatgtgtaaagaagtatgttttaggttggtttaaggttttttaaagttttatttttttgtttaggtgtttaattttgagtttggatggttttaatatttttattatttatatttaggttttttaataatgtaatttttatgatgatttttttagttaagtttttattttatttatttttaaatttgttaagtttttattgttttatttttagttttagtgatttttttgagttgaaaatatatggagttgagagtttgtgatttagagaggatttattaagtttagttaggagtttatttaatttagggaagtgtgttattgttgtggaaagtatgtttttagtttgaatgtaaagtgtttttggagtttagtagttatttgttttttggatggtggttttagatttttgagaagtttaaaatttttagtgttagttttgagtatatgggaggggaaaattttaattttattaatttttgtgaggtttttggtataaagttggatagttgttatgataagtaagggtaagtaatttgtttgttggaggaagtaaaggaaatggagttggggaggagggtgtagagttaggatttttgttgatttggtgttgtagatattaatattttggggtggaaaattttgtaagttagagttgtgagggtagaattggtggaaattattttggaggaattttgtattgtgttaaatatgaagggtggaaggaagaaagtttttgtgtttgtttttagttggattttttttttttattagttaaaatgttattttttaggaaggttttttgtaatattatattttaatgtttttttttagatattttatattatattattttatttaattttttttataatttttattattttgataagatttatttgtttattgtttttagtatatggaaatgtaagttttatgaggatatagaatttttttattattttatttattgttgtatttttgagtgtttatattagtgttgggtagtaagtaagagtttgataataaatattttttgaatgagggagataggtttgaagtttggagaatgagatgtagaagaggtgtaagatttgttgtgttttttgtaggtggtgggggggtggtgtaggtgttttaagaattattgtgggatttggtagggggagtgtaggtgttttttgttaagatagaagtgtttagattataatttttagtagttatgaggagttttagggtttgatgggaatgggaaattttttaattttttatgttttggttttgtgggttttgtgggttgtttgtgaaatttgatttgggatgtggtggtttaattggaaggtggattgaaattttgtgatagtaagaggtttgtagtgatttgtggtgttaaggaatatagtgtttttaaaagaattggtgtttgttgtttgtttttttttttgggagttttttgtttatttttagaagaggagggaagtataggtgggtttttttagttttgtgttggatttttgagaattttgaagttattttggttgaggttaatttttgttgtgttttttttgtagtatgaagattttggagatttaattgttagttttggattgttgttttttagattaggatttagttttagtttatttttttttttatgtttttttgatgaataaaaatgtggattttgaattgatgttattgttttttgaaaggggggatttgttttggttgtttttagattttgtggttggtttagttgtgttttaggagttatgggagggggatttagtttttttttttatttttttggaaatagagtttggtttttttagtgagttgagtttttgaattgaggagtaagaattttttgaaaatataagtttttttgtagaagaagtaaatgggagtttttttgaagaagaagtgaatgggttagagttggggtttggaaaagttatggaagatatttttggggaatttgttgtagaggatgagggagatatgtaagtggtgatggtagtggagtgtggagtttggggagatgaagtgtgaggttgatttgttttttggttttgagatttatttttttaggtttttgttttttttgtttggtgatttaggtttattgttttttattttttttttagtgtttggaattatagttttttttagttgttttgattttttagtggtttttggttagagtttagtatttaatttgagaattttttgaaaggttgtaagtggtaaggataataatggggtagggagttgattatttttgagatttttattgtaaaatagtttagttttttaggagagggatgttttagagttgggagaagtggtatgtagtttttttagattgagtttatattttatttagtagtttgtgttttttattttttttaaggatttaggggggtttatttattttagaggtaggtttagttttagttttatatttgaaaagtataggtttggttagttttttaatttttttttgtttttagggtttttgatg

SEQ ID NO: 355 - DNA, 4001 bp, Artificial Sequence
  chemically treated genomic DNA (Homo sapiens)
tgttaggagttttagaaataggggagagttagaaagttggttagatttatgttttttaagtgtagggttagggttgagtttgtttttggggtaggtaagtttttttgaatttttgagggaagtagaagatataaattgttagataaaatgtaagtttagtttaaaagggttatgtgttgttttttttagttttggggtattttttttttagaaaattggattgttttatagtgaaaattttgggggtggttagttttttgttttgttgttatttttattatttatagttttttaagaagtttttaggttgggtgttgaattttgattaggaattattgagaaattgaggtagttgggagaagttgtagttttaagtgttgaaaggaagatgggggataataaatttgggttgttaagtaaagggggtagaggtttggagaagtgggttttaggattagaggatagattgattttatattttatttttttagattttatattttattgttattattatttatgtgttttttttgttttttgtagtgggttttttagaggtattttttatggtttttttagattttaattttggtttgtttgttttttttttagaaaggtttttgtttgttttttttgtaggaaggtttgtatttttagaaagtttttgttttttgatttgaggatttaatttattaggggaattaaattttgtttttaggggagtggagagagaaattgggttttttttttgtagtttttgggatatagttgagttagttataggatttggggataattggggtggatttttttttttgggaggtggtggtattagtttagagtttgtatttttatttattggggaagtgtggggagaaggatgggttggagttgggttttggtttgaaggatagtagtttggagttaatggttgagtttttaaagtttttatattgtagaggaagtatagtggagattagttttagttaggatggttttgaagtttttagggatttgatgtagagttaaagaaatttatttgtgtttttttttttttttgggagtaggtagaagatttttgggaggagaggtgaatagtggatgttaatttttttgaaagtattgtgttttttagtattgtgggttgttatgggttttttgttgttgtgggattttggtttattttttgattgggttgttgtattttggattagattttgtgggtgatttatggaatttgtggagttgggatgtgaaaggttagaaggttttttgtttttattaagttttagggttttttgtggttgttgggagttgtagtttgaatgtttttattttggtgagaagtgtttatgttttttttattgagttttgtggtaatttttaaagtatttgtattgtttttttgttgtttgtagagggtgtagtaggttttgtattttttttgtattttattttttaggttttagatttgttttttttatttaaaaaatatttattattgagtttttatttgttatttagtattgatataggtatttaggaatataataatgaataagatagtagaaaaattttatatttttataaggtttatgtttttatgtattgaaagtaatgaataaataaattttattagagtgataagggttgtgaaggagattaaataagatggtgtgatataaagtatttgggagaaaatgttagggtgtgatattatggaaagtttttttaaaaaatgatattttaattgatgagaagaaaggatttagttgagagtaaatgtaaaagtttttttttttttattttttatatttgatataatgtaggatttttttaaaatgatttttattaattttgtttttatagttttggtttgtagaattttttattttaaaatgttagtatttatggtattaggttggtgagaattttgattttgtatttttttttttaattttattttttttgttttttttggtaggtggattatttgtttttatttgttatggtgattgtttagttttgtgttaggagttttgtaggggttgatgggattggggttttttttttttatgtgtttaagattggtgttaaaagttttgagttttttaaaagtttagagttattgtttagggagtaggtagttgttgggttttggggatattttgtgtttgggttgggagtgtgttttttatgatggtgatatgtttttttggattgggtaagtttttgattgaatttgatgagttttttttgagttatgggtttttggttttgtgtatttttagtttgggaaaattgttggggttgggggtggggtagtggggatttagtgagtttgggggtgagtgggatggaagtttggttagagggattattataggagttgtattgttgggagatttgggtgtagatgatggggatgttaggattatttgaatttaaagttgaatgtttaggtagaggagtggagttttggggaattttgagttggtttaaagtgtatttttttgtatatttatttggtgttgggtgtagggaatttttgaaataaaagatgtataaagtattgaggtttgagatttttggattttgaaatattgagaatttatagttgtatattttagagtttatggtattttagtgaaaattggggttttattttgaaatgattatttgggggtgatttggggagtttaagttgttaaggttttataatttttggatttttgttttttttggagtgatttttttaggtagtttttggttttgttagatggagaaaatttaattgaaggttgttagttgtggaagtgagaagtgttaaattaggggtttgtttgttaggttgaggaggattgttgtaatttgagaggtttggtagttttgttattgtttggttttatatttatatttttgttttttgtagtagtatttttggtttttttttgttggagtagtttattatttatttgatgagaggggaggagagagagagaaaatgttttttaggttggttttttttatttggtagagggaggttgttattttttgtttgtatttttttttttggattatttagttatggtttttgtaaaggtaggggtatttgttttgatgtaaattttaatttttttttttttttgaatggtgtgttttattttgtgggttgtttgtaatttaggtggatgttattatggtgtgagatagggagggaaagaagtgtgtagaaggtaagtttggaggtatttttaagaatgagtatattttatttttttggaggaaaaaaaaaaagaatgggtatgtttgagaattaaattttgaaagagtgtaatgatgggttgtttgataatttgttggaaaaataatttatttgttatttagttttgggttaggttattttagttttagatgtaggttgaatgttgtgaagtggaaggggtgggtttgtaggtgtttgtgtggttttttgtgtagttttttggtttgagttggttttttttggtaggaggtggaatttgaatttattttttttgttgttttattttttagtttgtggttgttttattttgtagtttttttttatgtatttgttgtgtattggttattttgtgttgtatttatgttattttttttttaaattgaggtggtatttatatatagtgttagtgtatatagtaagtgtataggaagatgagttttggtttttaattgttttgtgatgtttattaagttatagattttttttattgttttagaaatgttttattatgtttttttttagttgatttttgattttatttttattttgatttttataattattttgtttgttggagaattttatatagaatggaattaggttgggtgttgtggtttatgtttgtattttgggaggttgaggtgggtggattatttgaggataggagttttagattagtgtggttaatgtggtgaatttttgtttttattaaaaaatataaaaattagttgggtgt

SEQ ID NO: 356 - DNA, 4607 bp, Artificial Sequence
  chemically treated genomic DNA (Homo sapiens)
tgttatttatggaatgaagattttaaattttagttatgaggataattatttttttatttggggatagaatattagtatttaaattatttatttggtatgtggtagaggagaagagaattagaggagaagtagagatgataaagtagttatattatttattagtttataggtaatagaattattaatttgttttttgtgataaagtaataataaagagttgatattttttatatttttatttgtgtgtagttggtattgttgatatttatttttttaagggtatttttttagattttttatttgtttatggtatttttttgggttttgtatttgtttgggtatttgttggggttttgtatttgtttggtttttatatttgtttggggtatttgtttgggttttgtatttgtttggggtatttgtttgggttttgtatttgtttggggtatttttttgggttttttatttgtttagggtatttttttgggttttgtatttgtttggggtatttgtttagatattgtatttgttttgggtatttgtttgggttttgtatttgtttgggtattgtatttgtaggatttttaagttgtttttatttatgtggttgtttttggttttgtttgttggggatgttggtattgaggatgttttgtttgtggtttaggtttttgttgtttattaggtatttgttgtttggggagaatttgtagagtaagttggagagtttgaatattttggagaagtttatggttgttgtttgttgtgggtgttattttgtgtttgaaaatttgtgggatttttgggtgtgtagtaggttgtaatagttgatgttggtttttgaggttggaagttagaaggtggaagtgaattgtagtttattagtgttgttggtttttgtgtggtattgtggggtttgtagtttttgtgttgtagggttttaaaggaaatgtttatgttttttttgattagggatttttgatttgagaattttattttaaaggttgggaggtttttgagtatttttagttagggttgttgataaaaatgtagaaagtatagtaaaatttgaattttagatttataataaatttagttataagtatgtttttaaatattgtatgggatatgttaatatggaaaaattatttgttagtttgaaatttaaatttaattgagtgatttgtgtgtttgtgtgtgtgtatatatgtatatatatatatttatatttatatgtaaatgtatgtttatatgtaaatatatgtttatttataaatatatttttaataagtaatatggtgtttgttgtatatatattatattgtgtatgtaatgtataagtatttattttgtttgtttggggttttgtttgtttttgttgagtttgatttttttatttgttgtttggtttttgttttatgttttagtgttattgagattaaggagagaatgaatttgttgttgattgggtagagtgagtgtgtggattgtggttattgtttgtttattatttgtgtgtatttgggttggtattgggtgaagaattgtgtgggtttgggatttgggggtttagagggagtgagtttttgtgtgggtgtttggtttgtaggttttgtaggtttaggggtgtgttttgtttttatttttattttggattttggtttttttttttagatagtggttttttttatttttggtttttgtaggttgttagtagtttgtgttaggttttgttggtgtttttagggttttttagattgtgtagattttgatatttttgtttggttttgggttttgggagttgagagttggttagggttttgtttgtatttttgggtgtttagttttgggtttgttttttgtggatgttttaatttttttggttgaatggatggtggtgtgtgtgtgttttattttggtggtgttggttttttttgttgttaaaattagatttaaatttttgtatgggatttgtttttgggtttttattttgtgtgtttagtaaatagtgggtgagttatgaagatgtgtgagttagttggattttttttgttaggtgtggatttgttgtggttagagaatttagtttgtgttagtttggtttgtttgtgaagttatgggttttattgatgtgattttttaagatgtgggggttattatgggtagaggatattggtttggagttagattatgggttttataagtattagattataagtagtgttgttattgagagttgtttggaatttgtttagtatgttgggttttttagttagggtttggtgtatgtggttgagggttttggaagttttgatggtttaggaggagtaggtgggtggggtggtgggtgttgttggttggtagagagttttggtttgatttagtgtaggtttggtgtgtgtagagaataattttaagtgtattgatgtttgtgagttttttttaaatattgaatgggatttagagtttgagtttataggtggtggttgggggagggagtagggtgttggttgttgtttgggagtgtttgtgttttgggtgatttttggaaggatgtggggtttaaattttggttggggttgggagagtagtttttagaggttttttgtgggattttttgttgggtgggattgtggttttataggagaagtgggtggtaagttttgtttggtggaaagtagttgtttttttttttttgggtttggggtggtgttttttatttttgttttttgttttttatttttgttttttgttggttatattttttgttttttggattttaagtgttttgtgtgttgaggagtttagtgttagtggtggtggttaggagagatttgggtgttaggaaagatgggttgtttgggggatagtagggagtttgggggaaatgtaggtgttgggtatagagttggtattggtgtttttagttttgttgaagattgtggttgggtttggtttgtgggaggggttttggtgttggatttgttttggttttgtgtgggtggttttgttgggttttgtaggagtgatgtgtgttaaaaggtggtgggaaggaggtggggtagagtgtgtttgggattttgatttggatgtggttagttggagaggtggagtgttgggaggagattttggttttgttgtgatttggtggtttgtgttgtttttttgtgtgttgggttaaaaaggtgttaatgtttgtggttgtttattttttgtggtgttttttttttttgtgtttatataatttgtttaggggttgggtagtttgttttgtttttttgtttgtgtatttgtttggaggtttgtgtgtttgtgaaggggatgtagtgaaattggggtttgtgttaggttagttgggatggatgttgatgtttggggttgtgatggttgtaggtaggaggtttagggttggggggtggtttggttttgtgggtgggggttggagtgtagtgttgggtaggtatttgggtttgtagttttgaagttgggaggtgaggggagagtgattggggatgagttgggataaggtgatataggggtttttttggagttggattggtttttgggatttggtgtttgtgagaggttggagtggttagagtttagtttgtgaggagatgtgggttttgtttttagtgttggttgtttttggtgttaaagatagttttgtaggggttttgggagggttttttttttgttgttttttttttattttgggttttgagggttgttgggagggtaattttgggaagaggttggggtgtggggtgtgggtgtaggtggaaattgttagtaagtttttttttgtttgtgtgttttttttgatttgtagggttgtgttaattttgaggttttagtttttttgaggagttagggttaggtttttttttggatagggagaaggatttgggtgggggttttgatttatggagttggttattaagtggttttgatggttttttgagggatagttttttgtggttttgagtttgtttgttgagggtttttggtttgtttttggagtggttttaggtagagaaagtttgtgaagaaatggtttgggttggtttggagggagatattttatgtttttttagtttttgggttgtttttttttgtagtttttgttttttttggggtttggatttggggagtgatgattatttttgtttagtttgtattttggtttggatgttaggagataagtttatgtagtatgtatatgtttgttatataaataggggatagatagatgatttttaattagtaagggtgtagggaaaagtaatgtattttaaatttttgattagaggttatttgtttttaaagatgttgttatttgtttatttattgtttggatatttggaaatggtttaggtttattaatataatgttttggtttttgttgttttgttttttgttgttgttattgttgtttatttgtttagttttagttttgggggaggagtaaataaagtgtgtggtttttggtatttattgagtgttgagttatttttttttggatttatttggggaaagattaaaaagtattttattaagaataggatatggtgtttgaaatgttgttatatatgaatgtatgtatt

SEQ ID NO: 357 - DNA, 4607 bp, Artificial Sequence
  chemically treated genomic DNA (Homo sapiens)
aatgtatatatttatatatggtaatattttaaatattgtgttttgtttttaatgaaatgttttttaatttttttttgaataaatttaaagaggggtggtttagtgtttagtaagtgttagaggttatgtgttttgtttattttttttttagagttaaggttgaataaataaatagtaatgatagtaataaaaaataaaataataaaaattaaagtattgtgttaatgagtttgagttatttttaaatgtttagatagtgaataaatagatggtagtatttttggaagtaaatgatttttggttagaagtttggggtgtattgtttttttttgtatttttgttggttgaagattgtttatttgttttttgtttatgtagtagatgtgtgtatattatatgggtttattttttagtgtttaggttaaaatataagttgagtaaaggtaattattgttttttaagtttaagttttgggaaaggtaggggttgtaggaggaggtggtttaggagttaagggggtgtgaggtgtttttttttaggttggtttgggttatttttttatgggttttttttatttgggattgttttggagataggttaggagtttttgatagataaatttagagttatagggagttgttttttgggaaattattgaaattgtttagtaattaattttatgggttaaggtttttgtttagatttttttttttgtttagaggggggtttggttttggttttttagggaagttgaggttttgggattggtatagttttgtaggttggagggagtgtgtgggtggggaggagtttgttggtgatttttatttgtatttgtgttttgtattttggtttttttttggggttatttttttaatggtttttggagtttggggtggagaggggatagtaggaggagggtttttttggaatttttgtggggttgtttttggtgttaaaggtggttggtgttgagggtaggatttgtgtttttttgtaggttagattttggttgttttagttttttgtgagtgttaagttttaggggttgatttaattttgagggagtttttgtgttgttttgttttagtttgtttttgattgttttttttttattttttagttttggagttgtgagtttaggtgtttgtttagtgttgtgttttagtttttgtttgtggagttgaattgttttttggttttgggttttttatttgtagttgttgtagttttgggtattggtgtttgttttggttggtttggtgtgggttttggttttgttgtgttttttttgtgggtgtgtgagtttttgggtgggtgtgtgggtggggaggtagggtgggttgtttggtttttaggtgggttatatgggtgtggggaggggaggtgttgtggggagtaggtggttgtgggtgttagtgtttttttagtttggtgtgtgggaaggtagtgtgggttattgagttgtggtggggttaaggtttttttttggtgttttgtttttttagttggttgtgtttaagttggggttttgggtgtgttttgttttgttttttttttgttgttttttggtgtgtgttgtttttgtagagtttggtgaggttgtttatgtagggttgaagtaggtttggtgttagggttttttttgtgggttagatttgattgtgatttttggtagagttggggatgttggtgttgattttgtgtttgatgtttgtgttttttttggattttttgttgttttttagatggtttattttttttgatatttgggttttttttggttgttgttattagtgttgggttttttggtgtgtggggtgtttggaatttaaggggtaggggatgtggttggtggggaataggggtgaggggtggggaataggggtgaggggtgttgttttaggtttaggaggaggggaatggttgttttttgttaagtagggtttgttatttattttttttgtggagttatggttttgtttggtagaggattttgtggagagtttttgggggttgtttttttaattttagttggagtttgggttttatgtttttttaggggttatttaggatgtgaatatttttgggtggtggttagtattttgtttttttttttggttgttgtttgtgggtttgggttttggattttgtttggtgtttggaaggagtttgtgggtgttggtgtgtttggagttgttttttgtgtgtattagatttgtgttaggttaggttgaagttttttattggttagtgatatttgttgttttgtttgtttgttttttttaggttattggggtttttagggtttttgattatgtatattaggttttggttaggggatttgatatgttgggtgagttttgagtggtttttagtggtggtgttgtttatggtttgatgtttatggggtttgtgatttggttttgaattgatgttttttgtttatggtgatttttatgttttggaaagttgtgttagtgaagtttgtggttttgtgagtgagttgggttggtgtagattgggttttttggttgtagtgggtttgtgtttgatggggagggtttggttgatttgtatatttttatggtttatttattgtttgttgggtgtatggggtggggatttaaagatgaattttatgtagaggtttgggtttagttttggtaatagaaaaggttggtattgttggagtaggatgtgtgtgtattattatttatttggttggggaggttggggtgtttgtggggagtagatttgaggttgggtgtttggaggtatgagtaggattttggttggtttttagtttttagaatttagggttaggtggggatgttagggtttgtgtgatttggggggttttagaggtgttggtggggtttggtgtggattattagtggtttgtgggagttaggggtggagggggttgttgtttagggaagaggattggggtttggagtgggggtgagaatgaggtatgtttttgagtttgtgaaatttgtggattgagtgtttgtgtaggagtttgttttttttgggtttttaggttttagatttgtatgattttttgtttggtgttagtttagatgtgtgtgggtgatgaatgggtggtggttgtgatttatgtgtttgttttgtttagttagtggtaaatttgttttttttttgattttagtggtattggagtgtgaggtaagggttaggtggtaggtagaggggttggatttagtaaaagtaaataaaattttaagtaaatgaaataaatatttatatattatatatatgatataatatatgtgtgatagatattgtattatttattaaagatatatttgtaggtaaatatatatttatatgtaaatatatatttatatataaatataaatatatatatatgtatgtgtatatatatgtagatatataggttgtttaattaaatttgaattttagattagtgagtaatttttttgtattagtatgttttgtgtaatatttgggaatatatttataattagatttgttgtgaatttgaaatttaaattttattgtgttttttatatttttattagtagttttagttggaggtgtttaaaggttttttggtttttgaggtaaggtttttgggttggaaatttttggttggaagaaatgtgggtgttttttttaaagttttgtggtataagaattataagttttataatgttgtgtggaagttggtggtgttgataggttgtagtttatttttgttttttgatttttggttttggaggttggtgttggttgttgtagtttgttgtgtgtttaggggttttgtgggtttttgggtgtagggtggtgtttgtggtaggtggtggttatgaatttttttgaggtatttaagttttttagtttattttgtaagttttttttggatggtaagtatttggtgagtggtggggatttgggttatgggtaggatatttttggtgttagtgtttttggtgggtagggttgggggtggttgtgtgggtggaggtagtttggggattttgtaggtgtggtgtttggataggtgtggggtttgggtaggtatttggggtaggtgtagtgtttgagtaagtgttttagataggtgtgggatttaggaagatattttagataggtggagggtttggggaggtgttttaagtaggtgtggggtttaggtaggtattttaagtaggtgtggggtttaggtaggtattttaagtagatatgggggttggataggtgtaggattttggtaggtgtttgggtaggtgtgggatttaggaagatattgtagataggtggggggtttggggaggtgtttttggaaaggtgggtattggtagtgttgattgtatataggtgagggtataggagatgttggttttttgttgttattttgttataaaaggtaaattgatgattttgttgtttgtaaattggtaagtggtgtggttattttgttatttttattttttttttaattttttttttttttattatatgttgaataaatgatttaaatattagtattttatttttaggtaaggaagtagttgtttttatggttgggatttgaggtttttgttttatgggtggta

SEQ ID NO: 358 - DNA, 4453 bp, Artificial Sequence
  chemically treated genomic DNA (Homo sapiens)
ttggttttgaagtttatagtattgttgatttagtttgttttttggaaggttggtagtttagtaagtatagaagtttttttagaagatagtgggttatttgttttttaaaagttgaaaggttaatttgtattttttttagtaggtagttggtattttgagtttttggttggggtagagtaaaggagttttttttttttttatttttttggtattttttttgttttttttttgttatttttaggtggatttagatttaaggtttagatttgtaaggtaggaaaatgttgtaggtttaggttgggaaagggtttaaagttgttagtggattgttgggatttagtttttttttttttattaagagagtgagttttattgggtttaaaatgattttaagttttggtttttgatattaggggaaagagatgggggtgatagaattatagaatttttgttatgtttttttaagtgtgtttagagatgtgtgtgtgtgtgtgtgtgtatatataaatgtttgtttatttttaggtaggaagggtggatgtagttatttatatatggtttgtttttttggaggataattttatttgataaataattgtttttatttgaatagaataaataaggttttatgatgaagtaaaatattaaatatatatgtattaaaaaatgtataattatttttttggaatgggttatatagagatgtgttttttaaaatgttaagagtgtaaaaggataaatagtgaaaaataaattttttttttattttgttttttagttttttaatttttttatttagaggtgagaatagaatttttatattttttagaatttttatagttagaattgtttatatgtttttattgtttttatttttatttttgtttgtataaataaatgaattgtttattatggaaattttttaaaagatttgttaatattttaataggaagtattaatagtttatgttttaggattttgtttttataattttgtaatattatattatgatatttaatttaatttttattaagttttgttaaaaatggattttaaattaagttgtaaatttttagtaatttggttttgtttttttttttttgatagtattattaaataaatttttttattgttgaaagtaataagtttggttttgttttatttattggttgtgttggtgatatttggggattgttattgaatagatgtatagagggagtttttataggtaggggtttttttgtttgtgtttttgggagagtatgttttgtatatttgttgtgttgatgaagattttatagttttattagttgtgggtaagggggtttgaggtagttttaggtaagttggggtttagtggggagaagttgtagaagaattgattagaggattttaggaggttttagagttgggtgaggtagagagttttttgtgtgtttttttttttttttgtaatttggggattttttgtattggggtaggtttttggttaggtgtatgggaggaagtatggagaatttataagttttttgattttttagtttagatgttgttgggttttttttgttggagattgtgttttttttaaatttttgtgagtgttgtggaagtatgtggggtttgggttgttgagtgttgtaagataggggagggagttgggtgggagagggaggggtggtgttggggtgggttttgatatagagtaggtgttgtgggttgtagtatagtgtggagattgtagttttggagtttgggttagggtttatttgtttttgtagtgttggtttgtgtttttttgttgtagttattggtgagtgttgtggttttgagatttttgggttggatgtgtggtggttttagtttttgagtgtttgttttttttgttttgggttgtttgggttttttgggttttttggtggttgtatggagttaaggtgttttgttttgggtgttttttgtgggtgttgatttaggttgtttggagtttggagtttagagaggagagagatagttggggagtttggttattgtgggtattttttttgtgttgtagttgtttgtttggtttgtttttttgtttttttgttttttgttttgattttttttttttttgtagagttgttgtttagtgttttgattttgttattatgagagttttgttggtgtgtttgtttttttgtgttttggttgtgagtgattttaaagtgagtgtgtttttgttttgattgatgttgtttaaggatttttgattagtattaggggagaggaggggttgtttagggagttggggttttttggattttatttatagtagggttagattttttttaggaaatgggatagggtggtagtggaggtttgagaattatgggggttggtattggttggtaagggaggaagaggttgttgggattgttttagtttgtgggtatttggtagatgaagtttgtttgggttaatttattttttttggttggaaatttatggttttttatttgagaattagatatgaatagggtgaggtgagagggagagggaagagtgggttttgggattggggttagtttatttttattttggagtttttggagtatgggatttttgatgaagtttttttttgaattttttttagggtagtaatgaattttattaagttttatgtgagtatttatttttataatagttggttgtatagataagttgggaaggttttaggggatattttttttttgttttttgttgtagggttgtgttattttttattatttttatttttttttgtttattttatttttgttttttttagtgaattgtgattgtttaaatggaggaatatgtgtgtttaataagtatttttttaatatttattggtgtaattgtttaaagaaatttggagggtagtattgtgaaataggtatggggatttttattgtaattgggagagaaatttggggatagggagggatgggtgggaggtaagagtaggtaggagttaggagttggaggtagggtgggtgatatttttatttttatgtgataagtataaatatatatatatgtttatgaaatagtggttatataaatgtgaggtggggttggaaggagattttgtttagttttttggtaggtttgaaatgatatttttaaaatgtttgttggtagttgggtatggtggtttatgtttgtaattttagtattttgagaggttaaggtgagtggattatttgaggttaggagtttaagattagtttggataatatggtgtaattttgtttttattaaaaatgtaaaaattagtttggtatggtagtggatgtttgtagttttagttatttgggaggttgaggtaggagaattgtttgaatttgggaggtagagattttagtgagttgagattatattattgtattttaattgggtgatagagtaagattttattttaaaaaaaaaaaataaaagttagttggaatgttttttttttttttatatttttttatttttttgtttttttgtagataagttaaaaatttgttatgaggggaatggttatttttattgaggaaaggttagtattgatattatgggttggttttgtttgttttggaattttgttattgttttttagtaaatgtattatgtttatagatttgatgttttttagttgggtttggggaaatataattattgtaggtgaggtgggggtaataaggattaaaagttttttttatagttttttagaaattttgttattattttttttttttagagggttggttatagtataagagaagtgtggtttttggttgagttttttttgaggggaggaggtagggaaggttttttgggttggaatgatattttttatttttttgtgttgttaggaatttagataattggaggtgattttggtgttatgtgtaggtgggtttaaagttgtttgtttaagagtgtatggtgtatgattgtgtagatggtgagtattattgatttgttgatgatagtggggtggaaggggataaatttatatgtttttttattttattataggaggattgaggaggtggggggtgtttgagagggatgtttttttttatttgtttttttaagatatttttttgtttgttttttaggaaaaaagttttttttttttttagaagaattaaaattttagtgtggttaaaagattttgaggttttgttttaagattattgggggagaatttattattattgagaattagttttggtttgtggttatttataggaggtattgggggggttttgttatttatgtgtgtggaggtagttttattagtttttgttgggtgattagtgttatatattgttttatgtatggttttgggttttttttttttgatttttttgttttattttaagtatattttttttttttttttagtaaagtgttttgttttattttttttttatttgtt

SEQ ID NO: 359 - DNA, 4453 bp, Artificial Sequence
  chemically treated genomic DNA (Homo sapiens)
ggtagatgagggagaaatgaggtggaatattttgttgggaaggagaaagggatgtgtttggggtggggtagaagagttgaagaggagaaatttagggttgtatatgaagtagtgtgtggtgttgattatttagtaagggttgatgaggttgtttttatatatgtaggtgatagagtttttttggtgttttttgtagatggttgtaaattagggttggtttttgatggtggtgaatttttttttaataattttaaagtggggttttagagttttttggttatattgaaattttaatttttttggaggagaggagggttttttttttggaggataaatagagggatgttttagggaggtaggtaggagaaagtattttttttgggtattttttatttttttagtttttttgtgatggaataaggggatatgtaagtttgtttttttttattttattgttattagtaggttagtgatgtttattatttgtgtagttatgtattatgtatttttggataagtagttttaggtttatttgtatatagtattagggttgtttttggttgtttgggtttttggtaatatagaaagataggggatgttattttaatttagagggttttttttgttttttttttttagggaagatttaattagaggttgtattttttttgtgttatggttagttttttgggagaaggggatggtaataaggtttttgggaagttgtagggagggtttttggtttttgttgtttttattttatttgtagtaattatgtttttttaggtttagttgaagagtattagatttgtgggtatggtatgtttgttgaaggatagtggtagagttttagggtaggtagggttggtttatggtgttagtgttggtttttttttggtaaaagtgattattttttttatagtaggtttttgatttatttataaggggataggaggatgagagaatatgagaaagagaagaatattttaattaatttttattttttttttttgagatggagttttgttttgttgtttagttggagtgtagtggtgtgattttagtttattgagatttttgttttttaggtttaagtaatttttttgttttagttttttaagtagttgggattataggtatttattattatgttaggttgatttttgtatttttagtagaggtagggttatattatgttgtttaggttggttttgaatttttgattttaaatgatttatttattttgattttttaaaatgttgggattataagtgtgagttattatgtttggttgttaatggatattttaaagatgttgttttagatttgttagaagattggatagggtttttttttaattttattttatatttgtgtggttattgttttgtgagtgtgtgtgtgtgtttatgtttgttatatagggatgaagatgttatttattttatttttagtttttaatttttgtttgtttttgttttttatttatttttttttgtttttaaattttttttttagttgtagtggagatttttatatttattttatagtgttgttttttgaatttttttgggtagttgtattagtgaatgttggagaagtatttgttggatatatatgtttttttatttagatagttatagtttgttggagagaataaaggtggggtaagtgagggggagtggaagtggtaaggggtggtgtagttttgtagtagagggtagggaggggatgttttttgaagtttttttaatttgtttgtgtagttaattgttgtaggggtggatatttatatggaatttgatgaagtttattgttgttttggaagagatttgggaggaggttttattaaaggttttatgttttagggattttagggtgagggtaaattggttttaattttaaaatttattttttttttttttttttgttttattttgtttgtatttagtttttaaatggaagattatgggtttttagttaggagaaatggattgatttaagtaagttttatttattagatgtttgtaggttggggtagttttggtggttttttttttttttgttagttagtgttaatttttgtggtttttaagtttttgttgttattttgttttattttttggggagagtttggttttgttgtggatggaatttggaggattttagttttttgagtagtttttttttttttttggtgttgattagaggtttttgggtagtattagttaaagtaagagtgtatttattttggagttgtttatgattaggatgtagagaagtaggtgtgttagtagggtttttatggtggtgaggttggggtgttagatggtggttttgtaaaggaaggagaagttagggtaagaggtggaggaatgggaaggtaggttaggtgggtgattgtagtgtaggggagatgtttgtggtgattaggttttttagttgttttttttttttttgggttttggattttgggtagtttggattggtatttgtgggggatgtttgggatggggtgttttgattttgtgtagttgttggggagtttagggagtttgggtagtttagggtgggggaggtagatgtttgggagttggggttgttgtgtatttggtttggggattttaggattgtggtatttattggtggttgtggtaggagggtgtgagttggtgttgtggggataggtggattttggtttgggttttggggttgtggtttttgtattgtgttgtgatttgtggtgtttgttttatattagggtttgttttggtgttgttttttttttttttgtttggtttttttttttgttttgtagtgtttagtgatttggattttgtgtgtttttgtaatgtttataaagatttgggggaagtgtgatttttagtggaggggatttaatagtgtttggattgaggaattgagaggtttgtaaattttttgtgtttttttttatgtatttggttgggggtttgttttagtgtaaggagtttttgaattgtagagaggagagaaggtgtataggagattttttattttgtttagttttgaagttttttggggttttttaattagtttttttgtaatttttttttgttgggttttaatttgtttaagattgttttagatttttttgtttgtagttgatggagttgtgaagtttttattaatgtgataaatgtatgagatatatttttttagaagtatagatagaaaaatttttgtttgtaggggttttttttgtgtgtttgtttagtggtagtttttagatattattaatataattagtggatggaataaagttgggtttattgtttttggtagtaagggggtttgtttgatggtgttattagagggggaaaggtaaggttagattattgaaaatttgtagtttggtttaaagtttgtttttgatagggtttgataaggattgggttaggtgttgtgatatgatgttataggattgtgggaataaagttttagggtataaattgttggtgttttttattgaagtgttaatgggttttttgggaagtttttataatgagtaatttatttatttgtgtaggtaagaataaaagtaaagataatggaaatatgtagatagttttaattgtggaggttttggagggtgtggaagttttgtttttatttttgagtagaggaattgggagattggaggataaaataagaggaagatttattttttattgtttgtttttttatatttttaatattttaaaaagtatatttttgtatagtttattttaaaaagataattatgtattttttaatgtatgtgtatttagtgttttattttattatagagttttgtttattttatttagatagaaataattgtttattaaataaaattgttttttagaaaaatagattatgtgtaaatgattgtatttattttttttgtttgaggataagtagatatttgtgtatatatatatatatatatatgtatttttgggtatatttggaggaatatagtagggattttgtgattttgttatttttattttttttttttagtgttaggaattagggtttggggttattttgaatttagtaggatttgtttttttagtgggaaggaggaggttgagttttagtaatttattagtggttttgggtttttttttagtttaggtttgtagtatttttttgttttgtaaatttggattttgggtttgggtttatttgagagtgatagaaggaaggtagggagagtgttaggaaggtaggaaggaggaaggtttttttgttttgttttagttgagggtttagggtgttagttgtttgttggggaaagtataagttagttttttagtttttgggaggtaggtgatttattgttttttggagagatttttgtgtttgttgagttgttagttttttaggggatagattgagttagtgatgttataggttttagagttaa

SEQ ID NO: 360 - DNA, 6001 bp, Artificial Sequence
  chemically treated genomic DNA (Homo sapiens)
aaatttataggtgttggtgttatagaggaagagattattttttttgttattataattttaaatttaaagagaatattttagttattaaaatattttatagatttttaataaaaaaaagtattattttgaagttttaaaatatttgttttaaattttaaatttaataattatagttgtattgtaaggttattgtttattgataattttaaaatttagttaagtgattaatatttgtttttattttttataatttttttttagttaatttttttttagtatttttttttgatagtgttattttttaaagtttgtgttaatattgatagtggtgaatgaaagtttaatatttgttttttgttttttttttatttttattttttgtttattaggtggataatatttatgattataaaattttatattttggaaaagagttagtgatgatttttgaatatttttttattatttttttatttttaattgtttttttgttttaatgattgaaataattttttatttgaaatgtatttagataaagaggaaataaagttttaataataaagataaataggtatagtgttttttgtgatggtttgtttggtttaaatgaagattgattatttttaagttaataggggtggaagtggggtgttaagtttttgataatttatttgtaaaattagtttattttttttagtttatgtagttttttttaaaatatttggtaaatatgtaattttttgattgtaaatgttaattttatatttaagttagttattttttaaaataatgtaagggttaggaatgaagtaaattagtttgtgttggattataaagttattaatatttttaaaaattgtttttgtaggtttataattattattataataaagtatttaaaaagtgattaggtaatagtaaagtgaaatttatttttttaaaaataatatatatgtatgtatgaattaagaagttatagaaatatgttgagttttattaaaatgttaaatttagaaattgttaaaaaagagaataatttattgatttaaatttaatagggttgtatattttaatttgtttttgtaaaggataaattagaatgatgtataataattttttttttggtatttatattagtaataattaggaattatataggtttttattttgagttatagttggttatttttttttttttaaagttatatatattttagtttatatatatttttgaaagatattttatttagagttagatttaattatagtaaaattatatttatagaagatgaaaaattatatatatatttgttaaaattagaatagattatatttaggggataatatttaggtatgttaatggagtttaaaatgttaaggaaattatattataattttgtttagtatattataggttgttaaattgaaatgttatgttagttaggagtgtagtaatttttattttttggttttatttaattaggaagttttagtagagtgaagtttgttaagtgtttgttgttagaatttgaaggaatttgagtgagtaagaagagtgtttgatttattttatagaagtttgtttagaaatggaggagttagtgtttattgaagttggttttgtttttggtttgtttatatggagtttgattagttttagttatgtttattttggtttgggagatttgtaaagtgtttttttttttaatttttttgtattattttgaagtttagggaagtaaagagaggggtatatttggattgtaaaattaatgttttttgttgtttaggagagaagggaatgagagagagagagagatagatagatagagagagagagagagagagagagagagagagagagagagagagagaaattttattgaaatttagtttttttagaatttgtgtgatttggtttttaatgggagattagtgtgattttatggtatttttgttaggaattagtgatttttttgtagttattatttgatttattgtttttttgtttatttttttttataaagttattttttttttattttagtaagatttttttttttaatgatgataaagtttttgttttagtgttttttttaggattggtgtttttttaaaatagtgaatttagaaaattattttgtttaatattttttaaaatttttgtagttttaatgtaagtgtaagtatgtaaaggttttttgttatatttgtattttttgtttattttagaattattttttatttttgggtttgtaatagttttttttgtttttttggatagaggtgggtggtattaggggtttagggtagtaggaggtgaggggttgaggaggtgtgttagggtaggttggtttgtgttggatatgtgtgtttttttgtggagttaaagggttggggatgggggttttggatttattagagtaattttagttggtgggtgtttggtagttatttaaggaggtagggaaagtagtgagttttattgggtgggttatgatgagtagtatgatgggtagtagtagtagttagtaaaagtttttgtaaagtgtttagttgttgtattgttgtggggatttttatagtattatgattagtttgtgtaattttgtagtagtaaatggtttttgaggaatataggattgtgggggttgggtagtgggttattgagtattttgtggatggtggtagtagaggtggtggtggtggtagtggtatttggtggggaagtagtagttaaatttgtgtatgattttgagagttttagtaatatttagggattgggtttagttttggagtgagagggttgtttgttgagaagttgtgttggagatgtgggaagttgttgttataaggagggagttttgggaagttggaggataggaggagatgggagtttaggggtagatgagtggagtttgaggaggtagggtggagggagagttaaggtgttttgtagtttggtagttgttttttgagttttgttgtttgtatttttttggtgtttgggaagtagtaggtttttagtttgtttggggttatgtgggaagaggtagttgggttttgattggtggagtaggatgtaggttttgggagggaggggttgatgaggaggtgtaaggatgtaaggaggaggtggttgtggaagttatagatgggtttgtttgttaggtgttggtttgagtggggttaggtggggatggtttaaatgagaagtttgggttttagggtgggttatttgtatatttatatattatttgttttattttttgttttaggatgttttttattgaaggtggggtttggattagtgttttttttttgtgtgtgattttgggttgtgagtgtgggttgtggttgggtggtgtttttttgagttggagatggtgggggtggaggtgttagaggagtagtagtagtagggtagagaggggtgagttggtgtgggagagggtgttttgttggtgattggtgttttagtgtgtgggagtgtgttgtttaggttgtagggggatgtaggttgggaatgttgtggtggagaggttagggatgtttttttagggatttataggaaagagggtgagaggtgatggtgttagaattgtttttgttgatttggaagtaatagtagtattttttataagagtgtgtaattttaaggttgtttgttgaggtagtttagttattttggtaggtgttttttttttttttttttttttttttttttttttttaggttttttgtagttttgatttagtttaagtgtttgtaggtttgaatttttttttttattatttgtttttttttagtttgtagtttattagtgtgtttatttgggaggtgtggttagatgtgtttggaaggttagattggttgggataagtggtttgagagaaagagaaaggtttttttgtatatgttgtgggtgggttgttgggagtattggttgggtagtggtgtttgggaaggggagagtgggttttatttgttggtttaggtagtgattttgtgttttttatttgggtttttgttggatggttggtgatttggggtgatgagagaaggtttaatttggtaggagtttttggttttgtgtgttttttttattttttttagtgggaagggtaaatggtatagtgggatttgttttttgtttgttgtattttttaggtagttagatatattttttagtttaatggaattttagttgttagtaatgggattaagagtttttggggataagggtggagaggaatattttttttttatgattggggttattattgtagttttagtgttttggatgttttatagggaagagttttttttttggtgtgtgattatttagtgatttttgtttttgtttttgtttattttttttttgttttttttttttatttttttttgttatttttttttttttttttttttttgtttttaaaagtttttggattttttttttttttatttaaattttttttttgtgtttttttttttgtgttttttgaatttaggagagtatttgataatatttaataggtaattagtgtttatttttaattatttaaaagaggtatttatatattttgaaaatgggattatttattttttgtagatattagtagaaaaataaattgtatttgagtaatttttttaagtattttaatttttaatttttttttatttttttgttttttaattttttttttgagagatgtgattgtgtagtattttagtgttttaatgaaattttttttttttttttgtgtgaaatttatttttttattttatatttttgtttttgtttgagattgtttttttttttttttatttttaaagatttttgaattttagtgttttttatttttggtaattaagtagtagattttagtattttagttggtggtattttgttttttattgatgaagattttattaaaatagattaattagattagatgttggaggtattagaaaattggtttttagatagagtagttaaattttttaaggaaatagaatatttattagatagagttgttaattaatattgtaaaataaggaattagaaattttttttgttataggtttttagtagagaaggtaatataaatatagattaagatttaataattttatagtagagaatgagaatatgttattttttatagtaaggttggtgtggtaattaattaggtttatgaaaataagttatgtttgaaattaaaggtaaagtttttaaaagtgtttatgtagtaattatgataatgaaataggatttgttaggattttagagtttggttatgtaagtagaattttagagaattttttagtagaggaaaattgtttttgaattttttgttaagtaaatttttggtatattttttaataatatatgttttttttaagatgttttgttaaaagtaagttaaaattttaaaggagttaattattggttgtaattggttaataaatgtggttgtttttatagaggttttttaaattattaaatagtttgaagtaaagtttttttaatgggaatgttgtaattttgttgtatttattttgtatttagtgttatagtgttattaagaaataaattttgaaattggtaagtattattaagtggtagaagaatattatttattgagtagagaattgtattattgaatatgtaaataaaaatatatatattatttagatttgttattaggtattaaagaagtagataagattgtattagtaattggattagtgttttaatttttttttagtaaggtaaaattagtttatttattagaattaaatttaagtttatgaattgtattttgtattgtgtattatatgattgttagtaatatgatataattatattatgtatttgtaaaatttttattttaaaatattatattatatttatttttaatttttttgagttagaatattttatttgtggtatatatattttagaattgatgtagaggagtagagtttagttgtt

SEQ ID NO: 361 - DNA, 6001 bp, Artificial Sequence
  chemically treated genomic DNA (Homo sapiens)
aataattggattttgtttttttgtattaattttagagtgtatatgttataaataaagtgttttagtttaagaagattgaaagtaaatatggtatagtattttaaaataagaattttgtaaatatatggtatgattgtgttatattattagtaattatatgatatgtaatgtaaagtatagtttatagatttaaatttaattttaataagtaaattgattttgttttgttggggaaaagttaaagtattaatttaattgttaatgtagttttgtttatttttttggtatttagtgataagtttaaataatgtatatatttttatttatatatttagtaatataattttttgtttaatgagtgatgtttttttgttatttggtggtgtttgttagttttagaatttgttttttggtggtattataatattaagtatagagtaagtgtaataaaattgtagtatttttattgaaaaggttttgttttaaattgtttaataatttaaaggatttttgtggaagtaattgtatttgttaattagttataattagtaattaatttttttggagttttaatttatttttggtaaaatgttttaggaagagtatatattattagaaagtatgttaaaaatttatttagtagaaaatttaaaaatagtttttttttgttaagaggttttttaaaattttatttatatagttaaattttgaaattttagtaggttttgttttattattataattattgtataaatatttttaaggattttgtttttagttttaagtatgatttatttttataagtttgattagttattatattagttttgttatggaaaatgatatgtttttattttttgttgtagagttgttaaattttgatttatatttatgttgttttttttgttgaaagtttgtagtgaaagaaatttttaattttttgttttgtaatattagttggtagttttatttaatgggtattttgtttttttaaagaatttagttgttttgtttagaagttgattttttgatgtttttaatgtttggtttaattgatttgttttaatggagtttttgttggtgaggagtgagatgttattgattagaatgttgggatttgttgtttaattgttaggagtgagagatattgagatttagaaatttttggaggtgggaggggagagggatagttttggatggaggtggagatgtaagataaagggatggattttatataggaaaaaaaaaaagattttgttgaggtattgaggtgttgtatgattatattttttaaaggagaagttaaaaagtaaggaagtgggaggaggttggaggttaaagtatttaaaaggattatttgggtataatttgtttttttgttggtgtttgtaaaggatagatagttttgtttttaaagtatatgaatgttttttttaagtgattgggaatggatattaattgtttgttaaatgttattaaatgtttttttaaatttaggggatatagaaagaggggtataaaaggagaatttaaatagaaaaagggaggatttggaggtttttgaaagtggggggagaagaaggaggagggataatagagaggaatagagaaggagagtggagagaagataaataaaaataaaaataggaattattgaataattatatattaaaaagaaagtttttttttatggggtatttaaaatattgagattgtaatagtgattttggttatggaagaaagatgtttttttttatttttgtttttgaaagtttttggttttgttattggtgattaaaattttattaggttaaagagtgtgtttaattgtttgaagaatgtagtagatggaaggtgggttttgttatgttgtttgttttttttgttggagagaatgaaagaaatgtgtagagttagagatttttgttgagttagatttttttttgttgttttaggttattggttatttggtaaagatttgagtaaggaatgtagggttattgtttgggttaataaatggagtttgtttttttttttttggatgttgttgtttggttgatgtttttggtaatttatttgtggtgtatgtagaggagttttttttttttttttagattatttgttttgattaatttgattttttaaatatatttgattgtattttttaggtggatatattaataggttatgggttggagaggagtgggtgatgaggagagggatttaaatttgtgaatgtttgggttgggttggagttgtggggggtttgggaggagagaggggagaagagagaaggaaggagagtgtttgttgggatggttgagttgttttggtgagtagttttggggttgtatgtttttgtgggagatgttgttgttgtttttaggttggtaagagtggttttaatattattgttttttatttttttttttgtaaatttttagagaaatgtttttggtttttttgttgtgatatttttagtttgtatttttttatagtttaggtggtgtgtttttgtatgttggagtgttggttgttagtaggatgtttttttttgtgttgatttgtttttttttgttttgttgttgttgtttttttgatatttttgtttttattatttttagtttggagagatgttatttagttgtggtttgtatttgtggtttggggttatgtgtggaagaggggtgttagtttggattttgtttttggtagggggtgttttggagtggagagtgaggtgaatggtatatgagtgtgtgggtagtttattttgaagtttgagttttttatttgagttatttttgtttagttttatttgggttagtgtttggtgagtgagtttatttgtggtttttgtggttgttttttttttgtatttttgtatttttttgttgattttttttttttgggatttgtattttgttttattaattagagtttgattgtttttttttatgtgattttgggtgggttgaggatttgttgttttttaaatgttagagggatgtgggtggtagagtttgagaggtggttgttgggttgtggggtgttttgattttttttttattttgtttttttgggttttatttgtttgtttttggatttttgtttttttttgttttttggttttttagagttttttttttatggtagtagttttttgtgtttttggtgtagttttttagtggatgatttttttgttttggggttgagtttagtttttggatgttgttgaaatttttgagattatgtgtgggtttggttgttgtttttttgttgggtgttattgttattgttgttgtttttgttgttgttgtttgtgggatgtttagtagtttgttgtttggtttttgtgattttgtgttttttggaagttgtttgttgttgtagagttgtatgaattagttatggtgttgtgggagtttttgtggtagtgtagtagttggatattttgtgagggtttttgttggttgttgttgttgtttgttatgttatttattgtagtttgtttggtgaagtttgttgttttttttatttttttaagtgattgttaaatgtttattggttggaattgttttggtaagtttagaatttttgtttttgattttttaattttgtagaagaatatgtgtatttagtatagattagtttattttagtgtgtttttttagttttttattttttattgttttagatttttaatattatttatttttatttagagaaataaggggaattgttgtaggtttgggggtgaggggtggttttgggatgggtagaaagtgtaggtgtagtaggaaatttttgtatgtttgtgtttatattggagttgtgaggattttgagaaatattaaatgggatggttttttgggtttattgttttgaaagagtattaattttaggggaaatattgaaatagaagttttgttattattaaagaaaaaagttttattaggatgaggaagaaataattttatgagaaagaatgagtgagaaagtaataaattaaatggtgattgtaggggaattgttgatttttggtaaaggtgttatgaggttgtattggttttttgttgaagattaggttatatagattttagaggagttgggttttaatagaatttttttttttttttttttttttttttttttttttttttttttttttttatttatttattttttttttttttttattttttttttttttaggtggtaaaagatattggttttgtagtttagatatgtttttttttttgtttttttaagttttaaggtagtataggggagttgagaaaaagaatattttgtgggttttttaggttggagtgggtatgattgaggttggttaggttttatgtaggtgagttgagggtggaattgattttagtgggtgttgatttttttatttttggataggtttttgtggagtgggttaggtattttttttgtttgtttgggtttttttagattttgatggtgaatgtttggtaggttttgttttgttgaagttttttaattaaatagggttagaggatgggagttgttgtatttttagttggtatagtattttggtttgatagtttgtagtatattgggtagaattgtggtgtaatttttttggtattttaaattttgttaatatgtttgggtattgttttttaggtgtggtttgttttagttttagtaagtgtgtatgtaattttttattttttgtgaatataattttgttgtagttaaatttggttttgaataaagtgttttttaaagatgtatataagttgaagtgtatgtaattttagagaggagggaatgattaattgtaatttagggtgaaagtttgtatagtttttagttattattgatgtaaatgttaaaaggaaaattattatgtattattttaatttattttttataaagataagttgagatatgtaattttattagatttgggttaatagattgtttttttttttggtagtttttaaatttggtattttaataaaatttaatatgtttttataattttttgatttatgtgtatatgtgtgttgtttttgaaagaataagttttattttgttattgtttaattattttttagatgttttattatggtaataattatgagtttgtaaaaataatttttggaaatgttgatggttttgtagtttaatatagattggtttgttttatttttagtttttgtattgttttaggaaataattaatttaaatgtgaagttgatatttgtaattaagaaattatatatttattagatattttaaaggggattgtataaattaaagagaataaattggttttgtagataggttgttaagaatttggtattttgtttttatttttgttaatttagaggtgattaatttttatttgagttaaatagattattatagaaaatattgtgtttgtttatttttattattgaggttttgttttttttttgtttggatatattttaaataaggggttgttttagttgttgaagtaaaagaataattaaagatggggaaatggtaaaagggtatttagagattattattagtttttttttaaaatgtggagttttgtggttataaatattgtttatttaatgagtaaaaaataaaaataaaaaaaaaataggaagtaaatgttaagtttttatttattattgttagtattaatgtaagttttaaaaaatagtattattagaaaaggatattaaaggagaattgattagaaaagaattgtggaaaatggaaatgaatattgattatttaattagattttgaggttattagtagatagtgattttgtagtatagttatagttgttggatttaaaatttaggataagtattttaaagttttaaagtagtgtttttttttgttaaaaatttgtaagatgttttaatgattggagtgttttttttgaatttgaggttatgatgatagagaaaatgatttttttttttgtgatattaatatttgtaaattt

SEQ ID NO: 362 - DNA, 7001 bp, Artificial Sequence
  chemically treated genomic DNA (Homo sapiens)
aatgtaatggaaaaagagagattgtaaagttagaaggtttaggaattgttttttgattaggtgtggaaggtaagggaaaattagtttttgaagaagatagtgagattttaatttgggtggttggagagatagtgatgttgggtatagatatggggaagttgagaggaatattatgtttgagaatggtgatttatatttgaataagtttgtaatgtttagtagattgttggaaaagtggggttggagatatatttaatggaggagttagattaatttttatttttttttatttgagagagttagtaagttatggttggaatgtgtgtgtttagtaggagagggtagggagggaagttaagagagttgggagtttgagtgaagtttttgttaaaggtagaagaggaaagttggtgtagtatagtatatttttttatttatgtttattaagtttagggataaggtttattaagatgagtttggaagagaatgttggagagaaagtggttaagaaaattgtttttattgaattttttgggttaattttgattgtaagtttttgaataattaaagtttgtgaggagatagttaatttttttattttttttatgttaatagtgaataattgtagatttttttttttttttttttttttttttttgttttttttttttttttttttgaatatttttgtttttttttgggattggtttagagtatgggtggttattgttgatttataggaggtattattgttattaataaagggtaatagtttttttttttaatatttatttatatttagtatttatttttaatattgattatggagagagtttttttgtgtttaaatattgtaatattgggggttttttaaagtataaaaatatatatttgtatgatggtattattaatatttttatggttttttattttttttttgtattggttttaagagttatttataaattttttagtaattgtatagtgttttagggttagagattggttatttttggtattgtgattagagttatttaatatttaaggtggtgattaatgtttggtaataaagtttttattgggtgttatgtgttttgggattttgagtgtgggtattttaggagtattttagtattgtgtgttagtattatggttgagagaatagttgagaaagtggttaagaggtggatttatgtgaatgttattgggaaatgagagattttgtttttaattatggttagtgtaatttgaaagtttaaaattagtttaaaataaaggtatttatttttattttatgtttatattttaggtttttaataatatgtattttttatatgtttatagaaagtagttaattgagttatttatggaaaggtttgtgggtttggttaatgaagtggaggagtattatattttagttggaaatatatttttagaatgttaaaatatttattttaaagtttggttttttggtgtaattggaggtatggtaatgtttttgtttagagattgggggttagggttagtaaggtatttgatttatatgtattttagaaggtttttattgttaaattatatttttttggaaaaattatttatgttttattttgtaaatttgatatttatatatttttgattggtattttattttagttgtaagattatgatttatagtaagtttgtttttttttttgtttggggtggtagtagaaagtatagggtattttttagtttttaagggtaggggtaaaggggttggggttttttttttttagtatagttttttttggttgtgttatattgttttttgtgagtagatagtaagtttttttttattttttattgttatttatttagtgttgtgtagtagtttagttgtgtgtttgttgggaggggttgttaagtgttttgtttattggttgttttttgaatttttgttattttatgtataaatatatttatatattttttttgtttagtttatatattgagttatttgtatatgtgagtatatttttttttttttttttatttttttggtttttgatttttataagtttatggaatatttttggaaagatgtttttgatttagtagggtaggtttgttttgatttttttttttgtagttttagtattttgagaaagtaatttatttttttggttagtgtttgtattttagtagggagatgaggattgttgttttttatgggggtatgtgtgtgtttttttttttttttaggatttgtaggattttttgtgttatttgtatataatttggtaggtttatattttttaagagttttatgaagtgttttttgtatgtgttttaaaaaggtatttgaaaattgaaagtgtgatttatggaaattaaattatttgtaaaaaattgttttggaaagtaatgattgttggttataaagggaaatatttgtgatgtatttaatgtgtttttaattttttatttgttgataatttatagttattaatgttaaatttgattttggttttagttatatttgtatattgtttaataatggtttatttttgtaagaattagataaaatgtatatttgatataaaatagttaaaaatgtaatttttagtaatagtaagtttggtatttagatagattatgaatattttgttagatattttgttgggtgtttgggatagtaattaaaataaagtattgatagttgtattagagtttattaggttgtagtaaaggaagtttatttaaaagtataaattatttaagattatagatgtatgatatattttatttattttttgtttttttaatatgtatatatatatatatatatatatatatatatatatatgtgtgtgtgtatgtgtgtgtgtatgtttaatttttaatttagttaaaaatttttttttatttgttttttatttggatatttgattttgtatattttagtttaagtgaattgagaagattgagttgtaggattaaaggatagatatgtagaaatgtattttaaaaatttgttagttggattagattgataatgtaatataattgttaaagttttggtttgtgatttgaggttatgtttggtatgaaaaggttatattttatatttagttttttgaagttttggttgtataattaatttgtggaaggtatgaatatttatgtgtgttttaattaaaggtttttttgaattattttttatatgagaatttttaatgggattaagtatagtattgtggtttaatataaatatataagttaggttgagagaattttagaaggttgtggaagggtttatttattttgggagtattttgtagaggaagaaattgaggttttggtaggttgtatttttttgatggtaaaatgtagttttttttatatgtatattttgaatttttgtttttttttttttagatgttttttgttagtttttttagttgttaaatatagttgtttgtggttggttgtgtatgtaattgtatattttattttatttgttttattttggttatagtgtagttttttttagggttattttatgtatatattatgtatttttagttaatgaggagggggaattaaatagaaagagagataaatagagatatattggagtttggtatggggtatataaggtagtatattagagaaagttggtttttggatttgttttttgtgtttattttaagtttagttttttttgggttatttttagtagatttttgtgtgtttttgttttttggttgtgaaatttagtttttatttagtagtgatgataagtaaagtaaagtttagggaagttgttttttgggattgttttaaattgagttgtgtttggagtgatgtttaagttaatgttagggtaaggtaatagtttttggttgttttttagtatttttgtaatgtatatgagtttgggagattagtatttaaagttggaggtttgggagtttaggagttggtggagggtgtttgttttgggattgtatttgtttttgttgggttgtttggttttattggatttgtaggtttttggggtagggttggggttagagtttgtgtgttggtgggatatgtgttgtgttgtttttaattttgggttgtgttttttttttaggtggtttgttggtttttgagttttttgttttgtggggatatggtttgtattttgtttgtggttatggattatgattatgattttttatattaaagtatttgggatggttttattgtattagatttaagggaatgagttggagtttttgaattgtttgtagtttaagatttttttggagtggtttttgggtgaggtgtatttggatagtagtaagtttgttgtgtataattattttgagggtgttgtttatgagtttaatgttgtggttgttgttaatgtgtaggtttatggttagattggttttttttatggttttgggtttgaggttgtggtgtttggttttaatggtttggggggtttttttttatttaatagtgtgtttttgagtttgttgatgttattgtatttgttgttgtagttgttgttttttttgtagttttatggttagtaggtgttttattatttggagaatgagtttagtggttatatggtgtgtgaggttggtttgttggtattttataggtatttgtgtttgtgttgtttgttggggtggttgttgtgtttggtaggagggagggagggagggagggagaagggagagtttagggagttgtgggagttgtgggatgtgtgatttgagggtgtgtgtagggagtttggggtgtgtggtttagtttgggggttttgtgtgtagtttgtgttgtgtttagagttaagtttttttgttgggtagttgaaaaaaatgtattttttatttatttattgtttgtgtgagaggtagatttgaaagtttgggttttttaataaaatatatgttggaaaattagataaagtagtagttatttgtgggggaaaatatttttaggtaaataaatatggggtgttttgagttatttgggaaggttttgtttttggtatttaaagttgggggtgtttggagttagtagagtttagtagagttttatttatttttttaatgtttttgtttaatgtgttttttaaatttttttttatttagattatttgattggaaatatgttagttatgatgatgattttttgggaagtgatttttgttatttgttttttttttttttttattttatgttttggggttttagagagtgattgggagttgaatgggtttgattttggagttagttggttgagtttgtgttggagtggattgttggtatgtgatttttgatagttggaaatttgtaggtgttttgtgagtttaaaataagttatatggaagtataagtgtttaaaaataattttttgttagtttagtgataagtttgttttatttggggagaatgttttggagtggtgtgtgggttagttagggtttgtgttttgtagttattgtggaaggagtgtggttggtttaggatataggagattattttgtgattttaatggtgaaggttgtgtgtttttattttaatttttttttttataagaattgttttttttttttttttttttttttttatttttttttgtttagtttttttttttgttttttgttttttgtttttttgatgggtttgtagagggattaggtgggtgtttttggtgaatatttttttaggtggttataggataggtgtattttggattgggtttggaagttttagggtgttatatggttgggttttgaattaggtattttttaattgtatattggtatttggattggtgtttttatatttttttgttttgtaagttgtggattagtttttgtttagtattttgtttttagggatatttatagtagaaggaaggggattaaagtgtagtttggttttagaggatattgaagggtagattttgggggtatttagtgtgtatttttagttgttttggagaaatttagagtattttatagttatgtagatttaagttgtttttatttaaaagataaataatgaataaaatttttaaaggttggtatattttaaattaattttatttgttttaatttagggttaaaatagagaaaaaggattttttttgtttatttttttttttttaaatggaagaataaagtatagtgattaagtttaattttatataatatttaaaattgtttgatgtgaaggaaggtattggtatgatgtgaattttataattttatgatggattttagaaattatttttttttttatttaatttttagtttttttattgtaaattaatgttgttgaattttaatgggtattaatgagattgttttttggtagattatttattgttttgttaataattataaagtgaatttggttaaatatagaggggattgtattttatttaaaattgtttattattttagtgataagtggtattagtgtaatatgttttattttatattttttgtattatatgatatttaaatatttttagaataataaaaaaagagataaggaatttaaaaattaaaaaaaaaatttgtataaatgggattttgtgtggaaatttagttttagaatgattttttttgtgttttattttttggattatttttttttttttgttagaattttgtttgttattatttagtaaggaaaagaagtatttatgtaagttttttatatggatagatattatttagtatttttttttttttagtttttttgtttaaatgattttgggtataaaggaaaggattgattgggtttttttaggaaattttaagttttttaagtagtttttaaaagttttggggttgaaagtagtgtttttaaattgtttgttatgatttagagggttatgaatttagtttagtgagtttagaatattttttaaaaggattaaaatggaaaggaatataatagaaaatattagagtgtatggtattttgtaaggataagttttgt

SEQ ID NO: 363 - DNA, 7001 bp, Artificial Sequence
  chemically treated genomic DNA (Homo sapiens)
ataaaatttatttttatgaaatattatgtattttgatattttttattatatttttttttattttagtttttttaaaaaatattttagatttattaaattgagtttatgattttttgggttatgataagtagtttgaaaatattgtttttagttttaaaatttttgagaattatttaagaaatttaaagttttttaaaagagtttaattaatttttttttttatatttagagttatttaagtagaaaaattgagaggggaaaaatattaaataatatttgtttatatgaagaatttgtatagatgttttttttttttgttggataataataggtagaattttaataaaagaggaaagataatttgggaaataaaatataggaaaaattattttaaaattgaatttttatatagagttttatttgtgtaagttttttttttaatttttaagttttttgtttttttttttattattttaagagtgtttgaatattatgtaatgtagaaagtgtaagatagggtatattatattgatattatttattattgggatgatgaataattttgaataagatgtgattttttttgtatttgattaggtttattttgtaattattagtaaggtagtaaataatttattaaggagtagttttattagtgtttattgaaatttagtagtattaatttgtaataaaagaattgaaaattaaatagggaagaaaatggtttttggagtttattataaggttatggaatttatattatattagtgtttttttttatattaagtagttttaaatgttgtgtggaattagatttaattgttgtattttgtttttttatttaaaaaaaaaaaggtgggtagaagaaattttttttttttgttttaattttaaattaaaataagtaaaattaatttgaaatatgttaatttttaaaagttttgtttattgtttgttttttgagtaaagatagtttggatttgtgtggttgtgggatgttttaaatttttttaaggtggttgaagatgtatattgaatatttttagaatttgttttttagtattttttggggttaaattgtattttagtttttttttttttgttataaatatttttggaaatagaatattgaataaaaattggtttatggtttataaggtagaaagatatagggatattagtttggatattagtgtatagttgggaaatgtttaatttaggatttagttatgtggtgttttgaagtttttaaatttagtttggggtatatttgttttgtggttatttaggaaggtgtttattagaagtgtttatttaatttttttgtaggtttattaggaaaataaaaaataaaaaataaaaggagaaattgggtaagagaaaatgggagggagaggagagggagaaagaataatttttgtagggaaaaaaattaaaatgaggatatataatttttgttattgaagttataaagtggttttttgtgttttggattggttgtgttttttttatagtggttgtgaggtgtagattttggttgatttgtatgttattttggggtattttttttgggtgggataggtttgttattgggttggtaggagattatttttaagtatttgtgtttttatatggtttgttttaaatttgtgggatatttataaatttttggttgttagaagttatatgttagtaatttgttttagtgtggatttagttagttaattttgaaattagatttatttaatttttaattgttttttaaagttttaggatgtggggtggggaggaggggaaagtgggtgataggaattgttttttagaaagttattattatagttgatatatttttaattaaatagtttagatgaaaggaaatttggggagtatattaaataaaaatattaaaaggataaataaaattttgttgagttttgttaattttaaatatttttaattttaaatgttaagagtgagatttttttaagtgatttaaagtgttttgtgtttatttgtttggaggtgtttttttttataaataattgttgttttgtttggttttttaatgtgtgttttgttaggaagtttgggtttttgggtttgttttttgtatggatggtaagtgggtggagagtatgttttttttagttgtttggtgagagaatttgattttgaatgtagtgtgggttgtatgtagaatttttgggttgggttgtgtgttttgggttttttgtgtgtatttttgggttgtgtgttttgtggtttttgtagttttttaggttttttttttttttttttttttttttttttttttgttgggtgtggtggttattttgatgggtggtgtgggtgtgggtatttgtagaatgttggtgggttggttttgtgtattgtgtagttgttgggtttgttttttaggtagtagggtatttgttggttgtggggttgtaggaaaggtgatagttgtggtggtgggtgtagtagtattagtgggtttggagatatgttgttgagtggggggaaattttttaggttgttggagttgaatgttgtagttttagatttggggttgtaggggaggttggtttgattgtagatttgtgtgttggtggtggttgtggtgttgaatttgtaggtggtgtttttggggtagttgtatatggtgggtttgttgttgtttaggtatattttgtttaggggttgttttagggggattttgagttgtggatggtttaggggttttagtttgtttttttggatttgatgtagtagggttattttagatgttttggtgtggagggttatggttatggtttgtggttgtgggtagggtgtagattgtgtttttgtagggtagaaggtttagaaattggtgggttatttggaaaaagagtatagtttgaggttagaggtgatgtagtgtatgttttgttgatatgtgagttttggttttggttttgttttgggagtttgtgggtttggtgaagttgggtgatttgatgggagtaagtgtagttttaggatgaatgttttttgttagtttttgggtttttgggtttttaattttaagtattggttttttgagtttatatgtattataaaggtgttggaggatggttagggattgttgttttgttttgatattggtttaaatattattttaggtataatttgatttggagtgattttaaagagtagtttttttgaattttattttatttgttgttgttgttggatagaggttgagttttatggttagggggtgggggtgtatgaggatttgttaaaggtggtttagggaagattgggtttaaaataaatgtgaaagatggatttaggggttggttttttttaatgtgttgttttatgtgttttgtgttagattttgatatatttttgtttgtttttttttttgtttgattttttttttttgttggttagaaatatgtagtgtgtatataggatgattttggggaggattatattgtaattgagatagggtagatagaatggggtgtgtggttgtatatgtagttagttatagatagttatatttagtagttgggggaattgatagggggtatttgaggggaagggggtggagatttagggtatatatataggaagagttgtattttgttattaggagaatgtaatttgttaggattttagtttttttttttgtaaaatgtttttaaagtagatagatttttttataattttttgagatttttttagtttgatttgtgtgtttatgttggattatagtattgtatttggttttattaggaatttttatgtgaaggatgatttagaaaaatttttggttagggtgtatatgggtgtttatgttttttataggttggttatgtaattaaaattttagaaaattgaatataaaatgtgatttttttatattaaatataattttaggttatgaattaaagttttggtaattatgttatattgttggtttggtttagttaatagatttttaaaatgtatttttgtatgtttattttttagttttataatttgatttttttggtttatttgggttaggatatgtagaattaaatatttagatgaaaaataaatagaaaaaagtttttaattgaattaaaagttaaatatgtatatgtatatatatatatatatatatgtgtatatatatatatatatatatatatatatatattaaggagataaaaaataggtgaagtatattatgtgtttataattttggatagtttatatttttgaataaattttttttgttgtagtttaatagattttgatataattattaatattttgttttaattgttattttaaatatttaatagagtatttgatgaagtgtttatggtttatttaaatgttaagtttattgttattaagagttatatttttgattattttatattaagtatatattttatttaatttttataaaaatagattattgttggataatatgtaaatgtagttgaagttaaaattgagtttagtattaatgattatagattgttagtaaataaagggttaaaaatatattaggtgtattgtagatatttttttttatggttagtaattattattttttaaagtaattttttatagatgatttaatttttataaattatatttttaatttttaaatgtttttttaaaatatatgtaaaaagtattttatagggtttttaaaaaatgtgaatttgttaaattatatgtaaatggtataaagaattttataagttttgaaagaaaaaggagatatatatatatttttatggagaatagtaatttttatttttttgttaggatatagatattagttagaaaggtaagttgtttttttaaaatgttaaagttatagagagagaaattaaaataagtttattttgttggattaagaatgtttttttagaaatgttttatgggtttgtagaagttaagggttgagagagtgagaaggaaggaaggaatgtgtttgtatgtgtgagtggtttagtgtgtgaattaggtagagagagtgtgtggatgtgtttgtgtgtggaatggtagggatttgggaagtagttagtaggtagggtatttggtagttttttttggtagatatgtagttgggttattgtatagtgttggatgaatggtagtggggagtgaggggagatttgttgtttgtttatagggagtagtgtggtatagttagagaaagttgtattggggaggagaaattttagtttttttgtttttatttttggaggttggaaagtattttatgttttttgttgttattttaagtaagaggaaaaataggtttgttgtgaattatagttttatggttaaaatagaatgttagttaaaagtgtatggatattaagtttataaaataggatatgggtggtttttttgaaagaatataatttaataataaaagttttttgggatatatgtggattaaatgttttattggttttagtttttagtttttgaatagaggtattgttatgtttttgattgtattaggaaattagattttggaataaatgttttggtattttagggatgtgtttttagttgaaatgtaatatttttttattttgttaattaaatttataaatttttttatgaatagtttagttgattgttttttgtaaatatgtgaaaaatatgtattattaaaagtttaggatatgaatataagataaaggtagatatttttgttttaaattgattttaggtttttgagttgtattgattgtgattgggaatgaggttttttattttttagtggtgtttatatggatttattttttgattatttttttaattatttttttggttatagtattaatatgtaatattgaggtgtttttagagtgtttatgtttagggttttaggatatatgatatttaatggaggttttgttgttagatattagttattattttggatattaaatgattttaattataatgttaggagtggttggtttttggttttgggatattatgtagttattgagagatttatgagtggtttttgagattagtataaaaaagaaatagaaagttataaaaatgttaatgatgttattatgtaaatatatgtttttgtgttttgaaagatttttagtattgtagtgtttgagtataggagagttttttttatagttagtattgaaaataaatattggatataaataaatattgaaaagaaagattgttattttttgttggtgatagtggtgttttttgtaggttaataatggttatttatgttttagattagttttagaaaaaagtaagagtatttagggagggaggagagaggaataggggaaaggagaaggaaaggaaaggggatttgtaattgtttattattgatataggaagaataagaaggttagttgtttttttataggttttgattgtttagagatttataattaaagttagtttaagaagtttagtaaaggtagtttttttaattattttttttttagtatttttttttaaatttattttggtgagttttgtttttgggtttggtgagtatgggtgggaaagtatattgtgttatgttgattttttttttttgtttttggtaaaaattttatttgggtttttagtttttttggtttttttttttatttttttttgttggatatatatgttttagttgtgatttattggtttttttaggtgaagaagggtaaagattgatttggtttttttgttgaatgtgtttttagttttatttttttagtggtttgttgggtattgtaggtttgtttaaatatgagttattatttttaaatatggtgttttttttaatttttttgtgtttgtgtttagtattattgtttttttagttatttagattaaaattttattgttttttttgagggttgatttttttttgttttttatatttaattaagaggtaatttttaagttttttagttttataatttttttttttttattgtatt

SEQ ID NO: 364 - DNA, 3501 bp, Artificial Sequence
  chemically treated genomic DNA (Homo sapiens)
taattttgaaaattatttgtagatattttgtaggttttattttaggaataatggttatttttttgggtagttgaagtaaaattaagtttaatgataagtaaatataattattattaaaattttttatttatgtttgttaaagtaatttaagtatgatttgagaaggattttgtattttatatttgagtttttgtggatgaattgtaatttagtttaataggtagataagattgaaaatttaatttaggagtatgtgtttttaataatagttgagttttggttaattttagtggttatattttaattatttatatattgttgagtgtttaaattgtgtttaaagaaggtaaaagttaatttgtaattaatttagttgtttttttgttttatttttaatttttgtatgttatttttttttttttgtttataaatatgttttgattatgaggtatttttggagtttttgaatttgttgtgattttggaagttgttttatttgtaaattatttattatttaattaaattgttttaaatttaattttgttgaagtttttttttaataggtttagaaaaaataatggtaaaaatgaatgaaaatttaataattttggaagtagaaaaggttgggggttttaataagtgtaaatagttttatttttatattttttttatggtaattataatttagtatattatatatatatttttttgttttttgtattttggtttagggtaaagttttttaaaataggtattgttaattagtgttattaagaaggtttggatgttgttttgtgggaatattttaaagaggaatgtttaaaaggaaaagggggatgggttgggagaagggtattaggtgggtattttaaaattatttttagggttataggtttaatttatttggttgtggatgttagagttgttatggtaagaaggaagtaaagttttttgtaataattaaagtttttagaagtagtgtgttttattgtttattagtgtgttgtgaagtttggtgtttatttatagggttttttttagtattgtttaggttttttgagtgttttagtatagtagtttggagtttgttggtttggtgattaagatatattttagggaatatgttatgtagtggagttttttttttggtattgtatagtaaaaggaaagggttgttgggtgtttgtgggttttgggtagttatagaagttattgtgttggtggggaggagggggattgatgtggtttatgttttgggtagttttattttttttgtttgtgaagggtttttgtttggtgggaggagagaggtgtgttttatttgggtttttttatatttgttgttgtttgggttgattttgtgggttttgtttggtgttttagttgatttttgtttagttttgggtttatgggtgtggttagtagggtgggttagggtggtggggtgtgatattgggaggaagtgtgggttgtttgtttgggtgtgttaaggaagttgtttaaaatgaggaagagttgtgggtttggtggttgaggttattttggtggtggttggagagtgaggaggagtgggtggttttgtgttgtgtttgtttttgttttatttggtgtaggtaggtgtggttgtgttttttatttggttgggattttttggtaaggagaggaggttatggggaatgatgtgttgtttttatgtttttttttgttttatttttattggttgaggtaaaagtgttgaaattatgtgaataaaatataggtgggttttgttagttttgtttttgaatttatttgtgtttgggatttagaagttgtgttgggagagaggggtttaggtttgggtggaggggatggaggttagattgtgtggaaagtgatttgggtattttagggtgtttaggtttttagggagtgtggaaagtgtggttgtggtttggtttttgggagatgtgggattgggattaggtatagtgtgaggaagttgattttggagttagaatatttttttttggttatttatatgaatttattggaaaatgttgtagtgtttattaaagttatttaaagtagaaatgtttagatgttttatgagtttagataaattttttattataaaaagaaatagtagttgtatttaaataataatttttttgaattattattaaaatttagtataattatttttgtggatatatttttattgttaagtaatttatttagttaatgaatttggagagtaagaaagttttatgtagtaaaatgtaaatttgagttaagagttaagggtgtttttttttgtttgtttgtttgtttttggtaatgtggttttaaaattttaagtttatttaaaaattatataaatgtaatttatttttttgttggaatgtttaaggattagaaagataattggagaagtgagagtttgaatttttttttatgttggaaatagtgttgtaaaatattttttgagttttgtttgatttagtaaagatttagttgaatttaagtagagtttaaagtattgtagtgtgtagtaaaaaaaaaaaagagttgaagatgttgtgttatatttgatttttggtattaaaaataaaaaaaggaattatttaatttttaagagtttttggaagaaatggaattgattttattatttgatttttttgttttagtagggataaatttattgtttttatataggtagtattttaattaaatgtaattaaatatattgatgttttttttttttttagtgaaagtttgagtagtgtatagatagaattatatttttttaaaaaggtttaaatatatgtaaattattaagtgttttaagtgagaaatttttgttagttgaaattattttattaaattatttttgttttgaatggtatttttgttttaatgtatttagaaaatttttgtattaaaatagaaattgatttgtattattttttgtatttgaagtgtattttaaagtgtatttgaatgagagattataattaaattatttgatttgtgttttatttttttatttttttattttggatttgaaaaggttggatttgaatattaggaaaaaagagatttttttattgagggattgtgggaagatttttttttaagtttttgtatttgaagtgaaatataaaataggattttataatagttttaataattagaaagttttaagttaggataaaaatggggtgtatattttaggtttttattttttttgagagatgaaattggtagaaatgttattttattgttagattttattttagaaatgaattattttgatttttgttaggtttttatttaatattttaaatgtaggtttaatttttttgtttttttttaatggaagattttttagtagaattttatttatttagtatattgtttgtttatggttataatttaatatgtttgtgttaagatgtattttggaatttaagtttttttagaatttggaattaaaatttagaatttaaattttagaat

SEQ ID NO: 365 - DNA, 3501 bp, Artificial Sequence
  chemically treated genomic DNA (Homo sapiens)
gttttgaaatttagattttaaattttaattttaaattttgaaaaagtttgaattttaaaatatgttttggtataagtatattggattataattatgggtaaataatgtgttaaataagtgaagttttattaagaagttttttattaaaaaaaagtagagagattagatttgtatttagaatattaaataggggtttaataaagattagggtgatttatttttaaagtgaaatttagtaataaaataatgtttttattaattttattttttaggaaagataaagatttaaagtatatattttatttttattttagtttaaaattttttagttattaagattattataaaattttattttatattttattttaaatatagaggtttaaaaaaaaatttttttataattttttagtagaaaaatttttttttttttagtgtttaaatttaatttttttaaatttaaggtagaagagtaagaggataagatataaattaagtaatttgattataattttttatttaaatatattttaaagtgtattttaaatataggggataatataaattaatttttgttttaatgtaagagttttttaaatatgttaaaataaaagtgttgtttagaataaaaatgatttgataaaataattttaattgataaagattttttatttaaaatatttaataatttatatgtatttaagtttttttgagaaaatataattttatttatgtattgtttggatttttattggggagaaggaggatattaatgtatttagttgtatttaattaaaatgttgtttgtgtgaaggtaatgaatttgtttttattaagataaagaagttagatggtagaattaattttattttttttaggaatttttagggattaaatggtttttttttttatttttaatattaagaattagatatggtataatatttttaatttttttttttttttattatatgttgtaatgttttgaattttatttgagtttgattgaatttttgttaagttaggtaaaatttaaaaaatattttgtaatattgtttttaatgtaaaaaaagatttaaatttttatttttttaattgtttttttagtttttgaatattttaataaaagaatggattgtatttatatagtttttaggtgggtttaaggttttggagttatattgttaaaaatagataaatagataaaaagaaatatttttaatttttaatttaaatttatattttattatataaaatttttttgttttttaagtttattggttaagtaaattatttgataatgaaaatgtatttataagagtaattatgttaaattttagtagtggtttagaagggttgttgtttgaatgtaattgttgtttttttttgtagtaaaagatttgtttaagtttataagatgtttggatatttttattttgagtaattttgataaatattgtggtattttttagtggatttgtgtaaatggttaaaggaaaatgttttagttttaagattgatttttttgtgttgtgtttgattttaattttgtgttttttgagggttgggttgtgattgtattttttgtgttttttgggggtttgggtgttttggggtgtttgggttattttttgtatggtttgatttttgttttttttgtttaggtttgagttttttttttttggtgtagtttttggattttgagtgtgggtaggtttaggagtgaagttggtggaatttatttgtattttatttatatggttttagtatttttattttggttgatgaaggtagaataagaaagggtatgaaagtagtgtgttgttttttgtaattttttttttttattagaaagttttggttgggtaggggatgtggttatatttatttgtgttaggtgaggtgagggtgggtgtagtgtggggttatttgtttttttttgttttttagttgttgttggggtggttttagttgttgggtttgtggtttttttttattttgggtaatttttttaatgtgtttgggtaggtggtttgtatttttttttagtgttgtgttttgttgttttggtttgttttgttgattgtgtttatgagtttggagttgggtgggaattggttgaagtgttgggtgaggtttgtggaattggtttaggtggtggtaggtgtagaggagtttgggtggggtgtgtttttttttttttgttggataagggttttttgtaggtagagaaggtggggttgtttgggatatggattgtattggttttttttttttttgttagtgtggtggtttttgtgattgtttaggatttatagatatttagtggttttttttttttgttatgtagtgttggggaagagattttattgtatggtatattttttggagtgtattttggttattaaattaataagttttaagttattgtgttggagtatttgggaggtttgggtagtgttgagagggattttgtaggtgaatattagattttatggtgtattagtgggtaatggggtatgttgtttttgaaggttttaattattataaaaggttttgttttttttttattatgatggttttgatgtttataattaaataaattaaatttatagttttaagaatggttttgagatatttgtttgatattttttttttaatttattttttttttttttttggatatttttttttaaaatgtttttataaaatggtatttagatttttttgataatattggttggtagtgtttgttttaaaaagttttattttaagttaaaatgtgagaagtaaaaaaatatatatataatgtgttggattgtaattgttatggagaaaatatagggatgggattatttatatttattggagtttttagttttttttgtttttagggttattggatttttatttatttttgttattattttttttaaatttgttaaaagaaaattttagtagaattaaatttaaagtagtttaattgagtaatgaatgatttgtgaatggggtagtttttagaattatagtggatttagagattttagggatgttttatggttagaatatatttatagataaaaaaagggaagtgatatatagaaattggaggtaaggtagagaaataattggattggttataggttggtttttgttttttttgaatatagtttgaatatttagtagtgtatgaatggttgaagtatggttattgggattggttaagatttagttattgttaaaggtatatatttttaaattaggtttttaattttgtttgtttattaagttaggttatagtttatttataaggatttaaatatagaatatagagttttttttagattatatttaggttgttttaataaatataaatggaagattttgataatggttatatttgtttattattggatttaattttgttttaattatttgaaaaaatagttattgtttttgagatggagtttgtagaatgtttatagatggtttttagagttg

SEQ ID NO: 366 - DNA, 4216 bp, Artificial Sequence
  chemically treated genomic DNA (Homo sapiens)
aggtaataataattatgatgtattaggttttgggttaaagttattatttgtattaggttattaaatttttaggttaatttattatagttatgagttatttaataatagatatatttaataaattttttgttaggtaattttattattgtgggaatattttagagtggatttatataaatttagatggtttagtttattatatatttaagttatatggtttagtttattgtttttaggttataaatttttatagtatatgattgtattaaatattgaaggtagttgtaatatgagggtaagtattagtgtttttaaagatagaagatggttaggtgtggtggtttatgtttgtaattttagtattttgggaggtttaggtgggtggattatttgaggttaggagtttaagattagtttggtgaatatggtgaaattttatttgtattaaaaatataaaaattagttagtgttgtggtatttgtttgtagttttagttatttaggaggttgaggtagaagaattatttgaatttgggaggtagaggttggagtgagtttagattaggttattgtattttagtttgggtgatagagggagattttattttaaaataaataaataaataaataaataaaatatagaagatgtatagtaaaaatatggtaattgtttttgtttgtttgttttgagatagggttttgttttgttatgtggattggagtgtagtggtattattaggtttattgtagttttgatttttttggtttaagtgttttttttattttagttttttgagtatttgggattataggtttatgttattatgtttggttaatttgttttgaattttagtagagatggggttttattgtgttgtttaggtttgttttagttttttggttttaagtaatttttttatattagttttttaaagtgttaagattatagatgttagttattgtatttagttagtaatataattttatgggattatttttatatttgttgttttttgttgatttatatatttttatgtaatgtatgattgttattattattattatttttattttttagatggggaaattgaggtataaagaatttaatttgtataagtttatttgtttagtgatggaataaagatgtgaatttaggtagtttggttttaaagtttatatgtttaataattatattagattattagattgttttttttttttttttttttttttttttgagatggagttttattttgttatttaggttggagtatagtggtgagattttggtttattgtaatttttgttttttgggtttaagtaatttttttgttttagtttttttagtagttgtgattataggtgtttgttattatatttagttaatttttgtatttttagtagagatggggttttattatgttggttaggttggttttaaatttttgatttttggtgatttttttattttggttttttaaagtgttgggattataggtgtgagttattatgtttagtttagattgttttatttttgtatttgtatttatttatttatttattttgagatagggttttgttttgtagtttaggttgaagtgtagtggtgtaatttagtttattatagtttttatttattggggtttaaaggatttttttgttttagtttttggagtagttggggttataggtatgtattattatgtttagttaatttttaaatattttttggtagaagtagggttttattatgttgtttagattggttttaaatttttagttttaagggatttttttgttttggttttttaaagtgttgagattataggtatgagttatgtatttagtttttttttaaaatttttttgagagataagattttgatttgttgtttaggttggagtgtagtggtgagattatagtttattgtagttttaatttttgggtttaagtattagattttttttattatattttattttatatgtgtgtggttttaattttgtttttgttattttttagttgtatgttttaatttaatttgtttggttttgttttttttaatagaaggatggttttggttatgggttatagttagtaatgtttaagtattagggttggtgagtgttttgttgtggtatggttttagtgttgtgtttttgaatttatttgttttttttaatgagagaaggttttagatgagggttgaattttttttgttttgtttatggtttttgaatgttgggggaggagtgtatggggaggggtggtttttaaatgggttattgttattaatagagattttaaatattgtttgttaaaaatatttgattggaggagtataaaagtgtagttgagtttagtgttttgtatttttttgagtagatgtttagagtagagttagttagtatgattgagtgttgtgttttttttttgtttttgtggggttttagttgggattttttttgtgattggtatttgtatagttgtttttttgattaggtttttgggttgttttggttgttggaggagtggttgtagtggttaggtggtagtagttggttaggttatgtgtgttttttgttttttgttgttattgagagttttgtagtggttgtgtttgtttatagttgtgtgtttagttggtaatttagtagtggggttttggagatttggtatattgtggattgttggtgtgtgtttttggatgttaattattttgttttggatgagttgatggttaagattaaggatggtgtggtggagattattggtgagtttttttgtttttgtaggggagaggaggaggttagtagggtgggtagggttgggggtgtgtggttgaaatgggggttttgggggtttggggagttaaatgttggtttagtattgggaaaaataggatttttgatttttttgtttaggaattgggagtgtgggttgtttttaagggtgttttttgttttgtaattttagtgttttgggaggttgagatgggaggattgtttgaggttaggagtttaagattagtttgggtaatatagtgagatgtgtttttttgttttgattttgtgttattataaaaaaaaagtaaataaaaatttttttaaagattattgatgaagagagaaaatgtgtttttttatagagttttttttttatttatagttttatttttagataagtggggagttttttggtgtggtgttagtttttagttgttgagtgggtgtgtgtgtggttttaagtgtgtttgtgtattgtttattttttagttttgtgttttgttttgttttttttaaaattttgaattgaagaattttttggaagtttttgagagtttagattggtgggtatgtttttatttttaattttttttgttaatttttattagtttgtagttttggttgtttttaagtaggaggtggggtttttggtttagtggggttgaaaggtagtttttttttttgtagtttgattttttttttttttttaaaggtaagtatgaggagtggtaggatgagtatggttatattttttggtgttttatgtggaaatatatgtgagttttggtgttaggttggggtgggtgggtggtgtgggggtggggttagggaagagggtatagggatttatttggtgtgtaatgtaatgtttgttttttttttttgtatgtttaggttgttttttggtgtggattttatttaagtttttttttttttgttttttgagggtatattgattgtggaggtttttatgtttaagttagttatgtagtttaatgagattattattttagttatttttgagttgtgggtttagtttgggggtttagaagttgtaaaatttgatgagattgttgttaagtaaagttttagtttggatgtttatttttgttgttgttattggttgtgttttttttgttatttgtgtgtttttttgatatatttattttttgttttttttaaataaagtttaaagtaattatttgttattggtttaggttttggtgtttgtggaaggaagttttaggtatttgttatttgttggtttttaggagttatttttgtttaggtttgtgttgggttatgtgggtatattggtgtaggttgttggatataggttgatttatatttataaagatagaggttttagggttgggtgtagtggtttatatttataattttagtattttggggggttgaagtaggaggagt

SEQ ID NO: 367 - DNA, 4216 bp, Artificial Sequence
  chemically treated genomic DNA (Homo sapiens)
attttttttgttttaattttttaaagtgttgggattgtaggtatgagttattgtgtttggttttaagatttttgtttttatggatgtgagttagtttgtgtttagtaatttatattagtgtatttatatggtttagtatgggtttgagtaaagatgatttttgaaagttagtaaatggtaggtgtttgaggtttttttttataaatattagggtttgggttagtgataggtggttgttttgaattttatttgagaaaaatagaagataaatgtattaaaagaatatataggtggtgggggaggtatagttagtggtggtagtaggggtgggtatttgggttaaggttttatttggtggtagttttattggattttgtagtttttgggtttttaagttgggtttgtgatttgaaggtgattgggatggtgattttgttggattgtgtggttagtttgggtatgggggtttttatggttagtgtgtttttaggggatagggaggaggaaatttgggtggggtttatattggggggtagtttggatgtgtagagaggaaaggtaagtgttatattatatattgggtgggtttttgtgtttttttttttgattttatttttatgttatttatttattttgatttggtgttaggatttatgtgtatttttgtgtgaagtattgggagatgtagttatgtttgttttgttgttttttgtgtttgtttttggggggaagagggaaattagattgtgggggaggggattgttttttggttttgttaggttagaggttttattttttgtttggaagtagttaggattgtaggttggtagggattaatagagggggttggggatgggggtgtgtttgttggtttgggtttttagaaatttttggaaagttttttgatttagagttttgggaggaatggagtagggtgtggagttggggagtgagtagtatgtaggtgtatttggagttgtgtatatgtttatttagtggttagaaattggtattgtgttagggaattttttgtttatttggggatggggttgtgggtgggaaggggattttgtagaaaagtgtattttttttttttattgatgatttttaaaaaaatttttgtttgttttttttttgtaatggtgtggggttggggtgggggggtgtgttttgttatgttgtttaggttagttttgaatttttggttttaagtgatttttttgttttggttttttaaagtgttgggattatagagtagaaagtgtttttagaagtgatttgtatttttaatttttgagtaagggaattaggagttttgttttttttggtgttgggttaatgtttaattttttaggtttttgggatttttgttttaattgtatgtttttggttttgtttgttttgttagttttttttttttttttgtaggagtaggggggtttattggtgatttttattatgttatttttggttttgattgttagtttgtttggggtgaagtggttgatatttagggatatgtgttagtggtttgtagtgtgttggatttttgagattttgttgttgagttgttggttgagtgtgtggttgtaggtgggtgtggttattgtggggtttttgatggtggtggggggtagggggtgtatgtagtttggttagttgttgttgtttaattattgtgattatttttttggtagttggggtagtttgaaggtttggttgaagaggtggttatgtgggtattagttgtggaaggggttttagttggggttttgtaggagtgagaaggggatgtggtgtttggttatgttggttgattttgttttggatgtttgtttagaaaagtgtggggtgttgggtttggttgtgtttttatgtttttttagttgggtatttttagtaggtggtgtttgaggtttttattaatggtaatgatttgtttgagggttgtttttttttatgtattttttttttagtgtttaggggttgtgggtggggtgaagagggtttagtttttatttggaatttttttttgttaaggaaagtaaatgaatttgagagtgtgatgttggagttgtgttatggtagggtatttgttggttttggtgtttaagtgttgttggttgtggtttgtggttagggttgtttttttgttaaggaggatagagttagataggttgggttggggtatataattgagaagtggtagaggtaggattggaattatatgtgtgtgagatagaatgtgataaaaggagtttggtgtttgagtttaggagttgaggttgtagtgagttatgattttattattgtattttagtttaggtaatagattaaagttttgttttttaaaaaaattttaaaaaggggttgggtgtatggtttatgtttgtaattttagtattttgggaggttaaggtagaagggttttttgaggttaggagtttgagattagtttgggtaatatagtgagattttatttttattaaaaaatatttaaaaattagttgggtatggtggtgtatgtttgtggttttagttattttagaggttgaagtaggaggattttttgaattttggtgagtagaggttgtggtgagttggattgtattattgtattttagtttgggttatagagtaaaattttgttttaaaataagtaaatgaataaatataaatataaaaataaagtagtttgggttgggtgtggtggtttatgtttgtaattttagtattttgggagattgaggtgggaggattattagaggttaggagtttgagattagtttggttaatatggtgaaattttatttttattaaaaatataaaaattagttgggtgtggtggtgggtgtttgtaattgtagttgttggggaggttgaggtaggagaattgtttgaatttagaaggtagaggttgtagtgagttgagattttattattgtattttagtttgggtgatagagtgagattttattttaaaaaaaaaaaaagaaaaaagaaaaaagtaatttagtaatttggtgtggttgttaggtgtgtggattttgaagttagattgtttgaatttatatttttgttttattattaagtagatgaatttgtgtaagttagattttttgtgttttagtttttttatttggaaaatagagatgataatgatggtaatagttatgtattgtataaagatgtgtaagttagtaagggatagtaaatatgaaggtggttttataaaattatattattggttgggtgtagtggttgatatttgtaattttagtattttgggaggttgatgtgggaggattatttgaagttagaaggttggaataagtttgggtaatatagtgagattttatttttattaaaatttagaataaattagttaggtatggtggtgtggatttgtagttttagatatttaggaggttgaggtgggaggagtatttgagttaaggaggttgaggttgtagtgagtttgatggtgttattgtattttagtttgtatgatagaataagattttgttttaaaataaataaataaaaataattattgtgtttttattgtatattttttatgttttatttatttatttatttatttattttgagatggagtttttttttgttgtttaggttggagtgtagtggtttgatttaggtttattttaatttttattttttaggtttaagtgatttttttgttttagttttttgagtagttgggattataggtaagtgttgtgatattggttaatttttgtatttttagtatagatggggttttattatgtttgttaggttggttttgaatttttgattttaagtaatttatttgtttgggttttttaaagtgttaggattataggtgtgagttattgtgtttggttattttttatttttagaaatattaatatttatttttatgttgtagttgtttttaatatttggtgtagttatatgttgtagaggtttgtagtttaggagtagtaggttagattatatggtttaggtgtgtagtaggttagattatttaggtttgtgtaagtttattttgagatgtttttataatgatgaaattgtttaataaggaatttgttgaatgtgtttgttattaagtgatttatgattgtaatgggttggtttgaggatttggtgatttaatgtaggtgatgattttggtttggagtttggtatattataattattgttattt

SEQ ID NO: 368 - DNA, 11001 bp, Artificial Sequence
  chemically treated genomic DNA (Homo sapiens)
ttaagttagatgttttttaattatttgtggataggttaggtatattttgagtttaattttattttataggtttaatattttggagttagaaagtttttaggtaaaaagtttgaagggggtttttttatgttattagatggatttttgtatttttagaagattttttatattaggaaagattaaagtattaaggtaattttttttggttttttgggataattttaggttttggtatgagtggtttggaagtttttgttttagttataatgtttatatatttttggaattgttttgtagggtttgttttttagtataattttttttttaagttttattgtagttatagtttattagttttgtttagtgataattaagaaattaagaattatgtatttatgtttatttttttagagttatttttttttaggataaagtttagggttttgttattgggttttgttaggagttgtagttgtaggggttgtttattatttaatagtttttgtaagtatattgtgaaggggaagtaatgattagagatagggttagttgtttagtttttgtatgtttaggtgtatgtgtatatatttttatatagggtagggtggggtgggaagtttattttggttgtgatgtttagtgtgtttaaagagtgtaaatttgtgggggttatttattattaagaatttttgtagtagggttttaatgattttatgtgtttttgtgtgtgatagtatatgtaggtgtttgatagtatttttgggtaggtaaaaggaagtgtggtgtttgatatttgtgttttgttttgggttttgttgggtattttgtaaggagggtggttttttgttggagggtatagagatagggtgtattagttttagttgaattttgatgaagtttgtgtaagaattgtttttgttttaaagaaatagagaaattaaattttgataataggttttaggtgagatgttagtttatttggggttaggttgggtatgtataaattattgtttgtgtttatttaagataattttagttgtgattttttgagtattaggtatatagttgggtatttgtttttttttatgttttttttttgagtagttaatttattaagtttatgaagaggttgttgttgatttgggtattgtattttttgattttttgtttaattttagtttgagaaaggttaggtgttttttattttataggtttgttttgtaagatgggttagtatggatatagggtttttgaggaatttagggtttttttgaaaaatggtttttggggtagtttttggaaattgattgtttttggttttttgtttttgatgtatatatatatagttggtgtttattttgaatttattattgtttttggttttgtatgttttgggtggataagggaaagatagaattatttggtttttttttgttgtttgtttagggttttagtattgaatgtagttttaaggatattatagaagtaggggtaattgaaggtatatggttaggggttaggaatagttgagggattttgaagagggatttttatttaaagtaaaattaggttgggtgtggtggtttatatttgtaattttagtattttgggaggttaaggtaggaggattatttgatttttaggagtttgagattagtttgggtaatatagtaagattttatttttattaaaaaaagaaaaaaaaaaattagttaggtgtggtggtgtgtttgtagttttaattgtttaggaggttgaggtgggaggattgtttgagtttgggagattgtagttatagtaagttattattgtgttattgtattttagtttggggaattgagtgagattttgttttaaaatataaaaaataaaaataggttgggtatgttggtttatgtttgtaattttagtattttgggaggttgaggtgggtggattatttgaggttaggagtttgagattagtttgattaatatggagaaattttgtttttattaaaaatataaaattagttaggtgtggtggtatatgtttgtaattttagttatttaggaggttgaggtaggagaattgtttaaatttgggaggtggaggttgtagtgaattgagattgtgttattgtattttagtttgggtaataagagtgaaatttggttttaaaaaaaaaaaaaattagtaaaattatattttaattgtatattttgattatagtattttagttgagttggagtgagggtttgttttggagaaggtagtttattttttttttttgttttggtatggggttatgatttattgtagggtgagaggagtggagagtggtgtatattagtagtttagttattagtggatagagtagtatttggagttagttttttatgttttatatatagtgagaaaaattattgtgatatgatgtttaattttgatttaagttgtataaaaggtagttttaggttaggttttaatttgttagaggtatataggtagttttttggtgggtttttgtatttgtttgtgttgtttggagatttggtttaaagattttttttttttttgagatgaagttttattttgttgtttaggttgtagtgtagtggttggattttggtttattgtaagttttgttttttgggtttaagtgatttttttgttttagatttttgagtagttgggattataggtgtgtgttataataatatttggttaatttttgtatttttagtagagatgggattttattatattggttaggttggttttgaatttttgattttaagtgatttgtttgtttttattttttaaagtgttgggattataggtgtgaattattgtatttgatttagagatttttaatttgattatttattttttattttatttagggattggatttttgttggaagggtggagtgtgggatagggtagttagggttttgaattgattttttttttttagatttttttggttttattgtattagttttattttttgttgatgttagataggttttagttagaatgtgagtgttatagatatagttaagtttagtgttgattaatattttgttttagaagaatttttataaggttttttgtagaatgattttgtgtttagtttaggagagttagggttttttttgattttgttttggagtttttttaagtatttaaattatttgatggggataaatggagaggatagatgagggagtagggtggagtgttttagtagaatgttttttatttagaatttgttgttattttgtagttagtaaggatgtggggttaagaattaaggttagggttttataggaaaaaggtaaagggggaggggtgggaatttaagtttatttttttttttaagtatttaaaggttttttggatggagaagagtattggagtaaaaattttagtataaattttattggggatagtgggtaattttgttgggttagtaaaaataaatggtgtgggttttggaaaatgagggttggaggttgtgaataaagtagtggatgtgtttgtttagtatattaatgggaagaagtatttagatgggaggagtattaggggtaggagaaatgttagatagattttagtgttagggtaagaaggaagattattttgtttgtagaatagggagggtatagggatggtgttaatttgtttttgtgatggttttgagtttttatttaataatgagaaagtttgtttttttttttttttttggatgatttaggagttttgggttgggatgtagtgattttatttttagtttttttttttttggtgatgaatttttttatttttatttagaaaatagatttggattagaggtattgtatagtttttttaggattttaaaggaggaagagtttttttttttgtttttaaagttgtttgttggaagaggattttaatagttattttagttggatgtatagtaggattatggaattttttttttgtattatagggatttattttttattttattattgtttataaaaattgatggttttttttttgagatagagttttgttttgttttttaggttggagtgtagtggtgtgattttggtttattgtaatttttgttttttgggtttaagtaattttttgttttagttttttaagtagttgggattataggtgtttgttattataattggttaattttttgtatttttagttgagatggggttttattattttggttaggttggttttgaatttttgattttatgatttatttattttggttttttaaagtgttgggattaaaggtgtgagttattgtatttggtttaaaattgatgtttttttttttttttttaatatataatttgggattttttagttttttattttttttttttttttttttttttttttgagatagagttttgtttttttatttaggttggaatgtagtggtttagttttgatttattgtaatttttgttttttgggtttaagtgatatttttgttttagtttttttagtagttgggattataggtatatattattatggttagataatttttttgtatttttagtatagatggggttttgttatgttggtttggtaggttttgaatttttggttttaagtgatttgtttgttttggttttttaaaatgttgagattataggtatgagttattaagtttagtttttttttttttttttgagatagagttttattttgttatttaggttggagtgtagtggtatgattttggtttattgtaatttttgttttttggttgaagtgatttagttttttaagtagttgggattatagttatatattattatgtttggttaatttttgtatgtttagtagagatagggttttattatgttggttaggttgattttgaatttttgattgtaaatgatttatttgttttggttttttaaagtattggtattagaggtgtgagttattgtatttggtttttttttttatttttgagatagagttttattttgttatttaggttggagtgtagtggtatgattttggtttattgtaatttttgttttttaggtttaagtgatttttttgttttatttttttaagtagttgggattataggtgtgtatttttgtggttagtttttttttttaattggttagtgttttgtggtttttttatttttttatagtggaaaatggtttaggattgattgatatgaagataagtttaggggtttatatttaatttaatttttgtatttaagttttgggttaagattttggtgtgttgagtattatttattttgtaaggaattttgtaaaattttatttgaagtattatttataattttattttttttatttaaataaggatttttgttttatttttgttaggtatattgagttttatagtttttgttttttttttttggtgtttaggtttggttttttgagtttggtggttatattaatggtatttggtatatagttttttgataatggggatatttaggaggttttgagatattttatagttttgggttagtaatttggatttttttttttatttttttaggtattttataatttagttttttttttttttgtgggtaaagtgtttttgaatgtttatggtttaaaataagattttttttttatttatttttaaatttttttttagatttattttagaggaagggaatagaattttttatattttagtagttggtgataggttagaatagggaagaggtgagggtttagttggttttatataggagtgtagatggaggagtaggatttttttttgttttttaagtttttttaaatatattttttaatttttggtgaggatttttttttttttatatttttttttagtttttttaaggagggagtaggagtatttgaatgtggaaattgaggtgttagtttaaattgtttggttggttttagttatagttggataatgtttggtttaggtttattataagttatatagttgttttttttgtgtttaatttgtttgtgatagaaattaagggggttttggtatttagtatttaggtggtggaattggggttttatgtatggttttgtgggtaggtttttggttaggatttgtggggagttatgtagttaggagggtggggttgtttattgatttaggatgtggtaatggattggggagggtggagttttagtgattgtttttttttttgtttgttggtattttttggtttttatttggttttggtgtggtttgtgagttagtgaggtttgtgtggtgaagtattgtttgagttttgagtttgagtttttttggttgtagtagttattgtttgttgtgttgttttaggttattttgaaagaaggtgtttttgttttgtttatagttgtatttgtttgttttttagttttgtgtgtttgtagttgttaattattgttttggttgtgtgtgtgtgtgtatgtgtgttagtgtgtgtgtgtgtttgggttagagttgtgttgtaattgttaagattgaaatgtagattgttgggatttagtttttgttttattggggtaggaatgttggggtggggatatgtatgttttgtttttaggaatgattttattgttttggagttttatttatagattttatttattatagggaatgggggtgggtgttagtgtttgggtaagtgtataagagtggtttttggttggaggtgagggtgggaaggtgtgggaagtgtgtgtgtgtggagtttgggttagtttgggtttgggtttgtttgtagtgggtggagtatttgtggagttggtaatttaggttttttttttagtttttgtgtagaattagtttttttgtgttgttgggaaattggtaattagaatgttttttgtgtgtggtatttaggtagtttttgagaatgtttgtattgtggtttgtttatttttgttttttttatatgtttttggttttgtgtttattatgtttgtgttttgttttattgtgggtttttagtttaggttttggggtttgtaatagtttaggtagatgagtgtgtggtagtggtagtggtaggtgaatttgtaatttgtagagaggtttggtggtgaggtggaggagttttaggttggggaaatgttttggagattgaagggaagttttagggagagggttgttgtttgttaggttttgtaggtttgatttattttagtgggttattttatattgttatgtggattttaatgttggttatttgggtgtttggaaattggttggaaggttataggtagagaggtttgtttaatagttggatttttattgtttagtatagaattttttttttttttattggtaattaaaaaaataataataaaaaattgtgttttgtttttgttatttaggttggagtgtaatggtgtgattttggtttattgtaatttttgttttttgggtttaagtgatttttttgttttagttttttgagtatttaggattataggtgtttgttattatgtttagttaatttttgtatttttagtagagatggggttttattatgttagttaggttggttttaaatttttgattttaggtgatttatttgttttggttttttaaagtgttgggattataggtttgagttattgtatttggttttttattgggaatgtatatggaatatatttgtttatttatttgaaggaaaaattaaatatttttaatttatgtttgttttgtggttgttatttgtttttattttttttagattaagatattggtttttatatattttaattttttgtttttatttttttttttatttattttagttaggtttgtttttttttttaggaaattgtttgggatagggtttttagtgatttgtgtattattaaatggaatttagtgttttattttttatttttatttttttagtattatttgaagtttgttttttttgatttttaggggttatatttttttagttttttttttattttttgtagtttttgtttagtttttttgtagattttgatttaatttttatattttatgatgaagtttgggtttagttttgattattggtttggtttgtttatatttatttgttttagatttatggttgaaatattgatttaaatttttagattagattttttgtgttagtatttttattaggatgtttaaaagatgttttaagtgaatatggttaaaatttaatttttttttttttagttttattgttatatttgtttagttttttttttgtagtaaaaatggttattaggtttttagttattggagataaaagtttaaatttatttttgattttttttttgtttttatttttgataaatatgtttaaattattttgttttttatttttatggttattttatttttttttgagaatgttgtaatgttttagttttgttttttttttttttttttttttttttgagatagagttttattttgttgttaaggttggagggtagtggtatgattttggtttattgtaatttttgttttttgtgtttaagtaatttttttattttagttttttgagtagttgggattataggtatttgttattatgtttggtttatttttttttattttttagtagatatgaggttttattatgttggttaggttggttttgaatttttgattttaggtgatttatttgtttttgttttttgaagtgttgggattataggtatgagttattgtgtttggttttttgtttattttttgtattttgttataattttgtgttttttttagttgaatttgtgatgtttttttgtattggatgagagggtttttatgtatatatagatttgggatattatttatttataagtttttaaataggttagagtagtgatgtttaatttagattttatgttataataatttggggagtttttaaaatttattgatgtttagggtttatttttagtagttgatttaataggtttgtggtgggatttaggttagtggggaggattgtaaaagtatttttggtgattttagttggtgtttatttaggggagagtaatttttgtttgttggtgatttttaggggtgtagaaggattgttgggtgtgtggttgtgtgtatattttagtatttgatttattgggttagaaaagggtgtttgttaaataaagatttaataaaatttttgtttgtagggggtttattaaaggttttaaatttttttaggtttttttttataggtggtaatttttttttattttaaaggttttggagggggttatgagtgtttgagaagaggtaagtttgggaagatggattttgaggatagtaggtataaatttttttttaagaagggttaaggtattttaaagataagaaatttaaaattagtgtatttttatatataagtagttatttttgtttatttgtggtttagatatgagtggagtgtgataagggataaattatttttgtgtattttttagtgatggggtgaaagtaatggatttagtttttgggagttgtttttgttgattttttttgttgtgatttgatttgtggtgattgtgttgttttttggttgttttttttgtttttgtaggtgtgtggggttattatttatgtgtgtattgtaggtttttgtgtatgatgttttagatgaagttgttatagaggttgtattatgtgtgtgtggtgggttttgtgggttggaagtggtggttatggttagggattagttgttgtgtggggttgtatgtggtgttttgtgtgatgtgtagtgtgttggtatgttttagttgggtgtggttttttttagtgtgtttagtgggtgttagtttttgtagtttaatgagtttaggtttttttgatatggtttggttgggtttgtgttttgttggttttgggtgttagtaagtgtgggttgggtggggttatagggtgggttttgattttagtgttttttttaggatttagattgggtggtgggaaggagttgaggagagttgtgtaatggaaatttgggtgtagggattgtggggtttgaaggtggggttgggtgtgtttttgtagagttttttttgttttgttttttttttttttttttgttttttttttatattttattttggatggttataatgatggtgattgtaaagtattatgtggagatatttgtgtttttggaggttagttttattgtgttagaggaagagggtttttatatttggttttggtttttttggtttggtttgttgaagtaatatatttggtttatttattgggtggggtaggaagttttgagtttttatttggggtgaggaggagggagattggttagtagttttattgtttgttttgttttttattgtggagattggggttttggtagaggttggattgtgattttgaggtttaggggtgtattttgggtggatttttttggtatgggtggttggtttttagtaattgtagtttttatttggttttgttattttgggttgttaggatataagtttttttatgttttttttagtgtttgatttggtattttttgtaggtaggtgggtattgaggatggtaatgtatgtgggggatgtgggagtagggtttagaggtttaaggttttaggatatttttatttgtagtaatattatttattttggtattgtgagtagtgtttagaagtttttgtattgtagtaagtatagtggggttgttttggagttattgtttttagtatatttagtttgtaggttttagtttatttgggggaaagttaggaaggtttgattggttttggaaggtgggggtattttatttatatttatgttttttgtattttttttattttttttgttatttttataggttttatttttgtgtttgtagttgtaggttttgttttgaggggttgaatatatgttggagttggtgtttggtaattgtttgttatttgtttttgtttttttgttttagttgtttttagatttttgggatttagga

SEQ ID NO: 369 - DNA, 11001 bp, Artificial Sequence
  chemically treated genomic DNA (Homo sapiens)
ttttagattttagaaatttgggagtggttggagtgagaaaatagaggtaagtggtaggtaattgttaagtattagttttagtatgtgtttagttttttagagtaggatttgtggttgtaggtgtgaaggtaaggtttgtggaaatggtagggagggtggaggggatgtaggaggtatggatgtgggtggggtgtttttattttttagggttagttagatttttttgatttttttttaggtgggttgagatttataggttggatgtgttagaggtagtggttttagagtggttttgttgtgtttattgtagtgtagaggtttttaagtgttgtttatgatgttagaatgagtggtattgttgtaggtgagggtattttagaattttggatttttaagttttatttttatattttttatatgtattgttatttttaatatttatttgtttgtagggagtgttaagttaagtattgggaaaagtatggaaagatttgtgttttggtagtttagggtgatagagttaaatgagggttgtagttgttgagggttgattatttatgttaagggaatttatttagaatgtatttttgaattttaagattatggtttagtttttgttggagttttagtttttgtagtggagagtagagtgggtggtaaagttgttgattgattttttttttttttattttaagtgaaggtttgagattttttgttttatttagtgggtaggttaagtgtgttgttttagtaaattggattaggagggttagggttggatgtggggattttttttttttagtatagtaaagttggtttttagaaatatgggtatttttgtgtggtgttttgtggttgttgttgttgtggttgtttggggtggggtgtgaggaggggatgaaggagggaaggaagggtaaggtggggggggttttgtgagagtgtgtttagttttgtttttgggttttatagtttttgtatttaggtttttattgtgtggttttttttagtttttttttgttgtttagtttggattttgggggaggtgttgaagttggggtttgttttgtggttttgtttggtttgtgtttgttagtgtttaaagttagtgaagtatgggtttaattgggttatgttgggggagtttgagtttattgagttgtgggagttggtatttgttgggtgtgttgggaagggttgtatttggttggagtgtgttaatgtgttgtgtattgtgtggggtattgtgtgtaattttatatggtagttggtttttggttgtggttattgtttttagtttgtggggtttgttatgtatatgtggtgtgatttttgtggtgattttatttggggtgttgtgtgtaaaggtttgtagtgtgtgtgtgagtagtggttttgtgtgtttatgagagtggaaggggtagttaaggggtagtgtagttgttgtgggttaagttgtggtagagggggttggtggggatagtttttgaggattaggtttgttatttttgttttattgttgaagagtgtgtgaaaatggtttattttttgttgtattttatttgtatttgggttatagatgagtagaggtggttgtttatatgtaaaaatatgttgattttaagttttttatttttaaaatgttttggttttttttgagaaagggtttgtgtttattgtttttggagtttatttttttaggtttgtttttttttaaatatttatgattttttttagaatttttagggtgaagggaaattattatttatgggagggagtttggaaaaatttagaatttttggtgggttttttgtaagtaggagttttgttgagtttttatttagtaaatatttttttttgatttagtgaattagatgttaaaatatgtatgtagttatatatttagtagtttttttgtatttttgggaattgttagtaagtaaaggttgtttttttttgggtagatattagttggaattattaggggtgtttttatagttttttttgttagtttggattttattgtagatttgttgaattaattgttgggagtggattttaggtattagtaaattttaaaaattttttaaattattgtaatatggagtttgggttgagtattattgttttggtttatttaggaatttgtggatggatagtgttttaggtttgtgtgtgtatggagatttttttatttggtataagaggatattataaatttagttggggggagtataaagttgtgatagaatgtaaagaatgaataaggggttgagtgtggtggtttatgtttgtaattttagtattttggaaggtggaggtgggtggattatttgaggttaggagtttaagattagtttggttaatatggtgaaattttatgtttattaaaaaataaaaaaaaatgagttaggtgtagtggtgggtgtttgtaattttagttatttgggaggttgaggtgggagaattgtttgaatataggaggtggaggttgtagtgagttgagattgtgttattgttttttagttttggtgatagagtgagattttgttttaaaaaaaaaaaaaaaaaaaaaaagaataaggttgggatattgtagtgtttttaaagagaaataaagtagttatggagataagaagtaggatgatttgggtatgtttattagaggtagagataagggagaaattaaagataagtttgggtttttgtttttagtaattgggagtttagtggttatttttgttgtaaagaggaagttgggtaagtgtagtagtgaggttgaagaaaagggaattaaattttggttatgtttatttgaaatgttttttagatattttagtgaaggtattggtatggaggatttagtttgagggtttaggttagtgttttagttgtggatttggggtagatgaatgtagatagattaggttagtgattaggattgagtttagattttattgtgagatatggaagttgagttagaatttgtaaaggagttgagtaggagttgtagggggtaggaggaaaattgggagagtgtagtttttgggagttaaagggagtaagttttaaatgatgttgagggggtgagaatggagaatggaatattggattttatttggtagtatatagattgttgaggattttgttttgggtagttttttggaggaagaggtaagtttggttggagtgggtagaggggagagtgaaggtgaaggattagagtgtatagagattagtgttttggtttgaggggagtagagataggtgataattatagggtagatgtaggttaaaggtgtttagttttttttttaagtaaatgggtagatgtattttatatatgtttttagtgaagggttgggtgtggtggtttaagtttgtagttttagtattttggaaggttgaggtgggtggattatttgagattaggagtttgagattagtttggttaatatggtgaaattttgtttttattaaaaatataaaaattagttgggtatggtggtgggtgtttgtaattttaggtatttaggaggttgaggtagaagaattgtttgaatttaggaggtggaggttgtggtgagttgaaattgtgttattgtattttagtttgggtgataaaagtaagatgtagttttttgttgttgtttttttaattgttaatgaggaaaggggaagttttgtgttaggtgatagagatttaattgttgagtaggtttttttgtttgtggttttttggttggtttttagatgtttaggtggttaatattagagtttgtgtagtagtgtgaggtaatttattgagataggttgggtttgtggagtttggtgagtagtggttttttttttggggtttttttttaatttttgggatatttttttgatttggagtttttttgttttattgttaggtttttttgtagattgtaagtttatttgttattattgttgttgtgtgtttgtttgtttggattgttgtgggttttgggatttgggttgggaatttgtggtggagtgggatatgaatgtggtgagtgtggggttgagggtgtatgggaagggtgaggatgggtaggttatagtgtaggtatttttgagggttgtttgggtgttgtgtgtaaggagtgttttaattgttgattttttggtggtatagagaggttaattttgtgtgggggttgggaggggagtttggattgttggttttgtaagtattttatttgttgtaagtggatttgggtttaggttgatttaggttttgtgtatgtgtattttttgtatttttttgtttttgtttttggttagaggttatttttgtgtgtttgtttggatgttggtatttgtttttgttttttgtggtaggtggggtttgtgagtggagttttggagtgatgaggttatttttgggggtgaagtgtgtgtgtttttgttttggtgtttttgttttaatgagataagagttagattttggtgatttatgttttagttttaatggttgtggtgtggttttggtttgggtgtatgtgtatattgatatgtgtatatgtatgtatgtgattggggtggtggttggtggttatggatgtgtaggattgggggatgggtgggtatggttatgggtgaggtggaggtgtttttttttgaaatgatttggagtagtatgatgagtagtggttattgtagttaagaggatttggatttggagtttgagtagtattttattgtgtgaattttgttagtttgtaggttgtgttgggattaggtgggagttagggggtgttggtgggtgggaggggaagtggttgttggagttttgttttttttggtttgttgttgtgttttgggttggtgggtagttttatttttttggttatgtggttttttgtgggttttggttggggatttgtttgtggaattgtgtgtaagattttgattttattgtttagatgttgggtgttggggtttttttggtttttgttatagataggttgaatatggaaaaagtagttgtatggtttgtggtagatttgagttgggtattatttagttatgattaaagttgattgagtagtttggattagtattttgatttttgtgtttgaatgtttttgttttttttttggggagattaggggaggatgtggagagggaagagtttttgttaggaattgagaagtatgtttaggaaaatttgagaggtagagagagattttgtttttttatttgtatttttgtatggagttagttgagtttttattttttttttgttttggtttgttattagttgttggaatgtggaagattttgttttttttttttagggtggatttggagaaagatttgggaatagataggaaagaagttttgttttggattataagtatttaggagtattttatttataggaagggggaaagttagattataaaatgtttaaagaggtggaaaaagagatttaggttattaatttaggattgtaaggtgttttggaattttttaggtatttttattattggagaattgtgtgttagatgttattggtgtgattattaggtttagagaattaggtttaggtattaggaaaaagaaatagggattgtgaagtttagtatgtttggtagaaatggggtggaaatttttatttaagtaaagaaagtggagttgtgagtgatgttttagataaaattttataaaattttttataaaatgggtggtgtttagtatgttaaaattttagtttagagtttgggtgtaagggttgagttgagtgtagatttttgggtttgtttttatgttagttagttttgagttattttttattgtggaaaggtgggaaaattataagatattaattaattgaaaaggagggttagttatggaggtgtatatttgtaattttagttatttgggagggtgaggtagaaggattatttgaatttgggaggtagaggttgtagtgagttaagattgtgttattgtattttagtttgagtgatagagtgagattttgttttaaaaatagaaaaggaagttaagtatggtggtttatatttttaatgttaatgttttgggaggttaaggtaggtggattatttgtaattaggaatttgaggttagtttggttaatatggtgaaattttatttttattaaatatataaaaattagttgggtatggtggtgtgtgattgtagttttagttatttgggagattgaattattttaattgggaggtaaaggttgtagtgagttaagattgtgttattgtattttaatttgggtgatagggtgaggttttgttttaaaaaaaagaaagaaggttgggtttggtgatttatgtttgtaattttagtattttgggaggttaaggtaggtagattatttgaggttaagagtttgagatttgttaggttaatatagtaaaattttgtttgtattgaaaatataaaaaaattatttggttatggtggtgtgtgtttgtaattttagttattggggaggttgaggtaggagtattatttgaatttagaagatagaggttgtagtgagttgagattgggttattgtattttagtttggatgagagagtaagattttgttttaaaaaaaaaaaaaaaaaaaaagaaagaataggaggttgagaagttttaagttatatgttaaaaaaaaagaaaaaaatattagttttaggttaggtgtagtggtttatatttttaattttagtattttggaaagttgaggtgggtggattatgaggttaggagtttaagattagtttggttaaaatggtgaaattttgttttgattaaaaatataaaaaattagttagttgtggtggtaggtatttgtaattttagttatttgggaggttgaagtagagaattgtttgaatttaggaggtagagattgtaatgagttaagattgtattattgtattttagtttggaaaatagagtgagattttgttttaaaaaaaaaattattagtttttatggatagtggtagagtggagggtgggtttttatggtgtagaagggaaattttatggttttgttgtgtatttgattgggatggttgttgaaatttttttttagtaggtagttttggaaatagaaaaagaaatttttttttttttagaattttggaagggttgtgtagtgtttttaatttaagtttgttttttgagtgaagatagggaggtttattattagaagggaaggggttggaaatgaggttattgtattttagtttagggtttttgggttatttaggaagggaagaaggagtaagtttttttattgttaggtaggagtttagagttattataagaataagttagtattatttttgtgttttttttgttttgtaaataaaatgatttttttttttgttttggtattagagtttgtttggtattttttttgtttttagtattttttttatttgggtatttttttttgttggtgtattgaataaatatatttattgttttatttatagtttttagtttttattttttagggtttatattatttgtttttattaatttgataaggttgtttattgtttttagtaaggtttgtattggggtttttattttagtgtttttttttatttaggagatttttggatatttggggaagaaaatgagtttaaatttttatttttttttttttattttttttttgtaaggttttggttttagtttttagttttatatttttgttggttgtagaatagtagtgggttttgggtaaggagtattttgttaaaatgttttattttgtttttttatttgttttttttatttgtttttattagatggtttaagtgtttaaggggattttagggtggagttagggagaattttggtttttttgggttaggtataagattattttataggaaattttgtgggaatttttttgggataaagtattggttagtgttgagtttagttgtgtttgtgatatttgtattttaattagggtttatttgatgttaataggaagtaaggttgatgtagtggggttaagggagtttgggagaagaaagttggtttagagttttggttgttttgttttatattttatttttttggtaagaatttagtttttagatgaggtggggagtgagtggttgagttaaaaatttttgggttgggtatgatggtttatgtttgtaattttagtattttgggaggtgaaggtaggtggattatttgaggttaggagtttaagattaatttggttaatgtggtgaaattttatttttattaaaaatataaaaattagttgggtgttgttgtggtatgtgtttgtagttttagttatttgggagtttgaggtaggagaattgtttgaatttaggaggtagaatttgtagtgagttaagatttagttattgtattatagtttgggtgatagagtgaggttttgttttaaaaaaaaaaaaaatttttgggttaaatttttagatagtataggtaggtgtagaaatttattaggaagttgtttgtgtatttttggtagattggagtttggtttaaagttgttttttatgtagtttgggttaaggttaaatattatgttatagtgattttttttattatgtgtgagatatggagaattggttttaagtattattttgtttattggtggttggattattgatgtgtattattttttattttttttattttgtagtgggttatggttttgtgttggggtagaggagaaaaatgggttgttttttttaggataaatttttattttaatttaattagggtgttgtgattagaatgtgtaattgaggtgtgattttattgattttttttttttttgagattgagttttgtttttgttgtttaggttggagtgtgatggtatgattttagtttattgtaatttttattttttgagtttgagtaatttttttgttttagttttttaagtagttgggattataggtatgtgttattatgtttggttaattttgtatttttagtagagatggggtttttttatgttggttaggttggttttaaatttttgattttaggtgatttatttgttttggttttttaaagtgttagaattataggtgtgagttaatgtgtttagtttgtttttgttttttgtgttttgaagtagggttttatttagttttttaggttggagtgtagtgatatgataatagtttattgtagttgtaattttttgggtttaaatgatttttttattttagttttttgaatagttgggattataggtatattattatatttggttaatttttttttttttttttttagtagagatgaggttttgttatgttgtttaagttggttttaaatttttgaggattaagtgatttttttattttagttttttaaaatgttgggattgtagatgtgagttattatatttagtttgattttattttaaatgagagtttttttttagagttttttagttgtttttggtttttggttatgtgtttttagttgtttttgtttttgtggtatttttaaggttatatttagtgttgaggttttaggtaggtagtagagagaagttaaatgattttgttttttttttatttatttagagtatgtaaaattaggagtagtggtgggtttagggtgggtattagttatgtatatgtatattagggatagggggttaaaggtagttagtttttaaagattgttttagaggttattttttagagaagttttgggttttttaagggttttgtgtttatgttggtttattttgtaggatgagtttgtggagtgggagatatttgattttttttaagttgagattgagtagaagattaaggagtataatgtttagattaatagtaatttttttatgagtttggtgagttgattgtttaggaagggggtgtggggaggagtaggtatttagttatgtgtttgatatttagagggttataattgaggttattttgggtgggtgtaagtagtaatttgtgtatatttagtttagttttaagtagattgatattttatttggaatttattattaaggtttggtttttttatttttttagaataaggatggtttttatataggttttattaaggtttagttgaagttggtgtgttttgtttttgtgttttttagtaagaagttattttttttgtaggatgtttggtggggtttaggatggggtataagtgttaggtgttgtatttttttttatttgtttaaggatgttgttaagtatttgtatgtgttgttatgtataagggtatgtgaagttattgaggttttgttgtgaaagtttttggtggtggatgatttttgtaagtttgtattttttgagtgtgttgagtgttatggttaaggtgggttttttattttattttgttttatgtgagggtatatatgtatgtatttgagtatgtaggggttgagtagttggttttgtttttgattattattttttttttatagtgtatttgtggaagttgttggatgatgagtagtttttgtggttgtggtttttggtagggtttagtgataaggttttgagttttgttttgaaggaaaatgattttggggaggtgaatgtgagtatatagtttttagttttttggttgttattagataggattgatgggttgtagttatagtaaggtttggaggaggaattgtgttggaagataagttttgtaaaatagttttaggagtgtataggtattgtaattaaagtaaaggtttttagattatttatgttaaagtttagggttgttttaagaagttaggaagaattgttttggtgttttgattttttttggtgtggaaaattttttggagatgtaggagtttatttaatgatatgaggaggttttttttagattttttatttggaagttttttggttttaaggtattaggtttgtggagtgaaattagatttagaatatgtttgatttgtttataggtaattggggaatatttgatttgg

SEQ ID NO: 370 - DNA, 4448 bp, Artificial Sequence
  chemically treated genomic DNA (Homo sapiens)
tttattttttttatgtgttttttttgtttagttttgtttatttggtgtttttgatattttttttttttattttattgtttttgaggtttattttattttttggtttttaattatttatttatgtaggatgtgaatttttaaattagtatttaagatgtatatttggatatttattttaatgttttagttttaaatttaatatattaaaagttgtattttttatgtttattattagttttaaagaatgtataattgaataaaattttgattattattttatattttttttttttttgagttatttatagaggtgattaagatagaaatgtgtgttattttttatttattttattgttattaattatatgtatttattaaattatgttagttttatttttttaataattgtagtttaatatttgaataattgaataaaaatttataatttaatttttttaatatttatttattttaattttatttttataatttatatataatttataattatttttatataattggtatagtgataattttagataaaatttattgaatttttatttttatttttgttaatgatatatatatataatgtaatgttgagagggttgggaaggaagaatgggagaaaggtagaagttgatagttaaaaaaaaaaagtttttagatggtttttttagtgttatttttgtaattttattaaataagggtttaaaatttatgttataatatttgtttgatgttttatttaaattgttttattggatattttttatttgttaagttttttgaaagaaataaaattgttttgttatagttagattttatgattttatatatttataatgggtagattttgtaggggtttatattttttaaggtggtttgggaaaatgatatagaaaagttttatattagttgaaaagaaaaatgtataatttattttggtaattttagttttaatttttaataggataaaggaaatatgtatattataaattaatgttttgtgttaataaataattaagtaagtagagttgtaagtattggttaaaatgaattttggatatttttagttattaaattttttgaggtaaggtagatatatatttggatttgaatatttgtattattagggaatttttgtttgtttgttttatattgttttgttatttttaaaagtaggtgttaaattaggttatttgttgtttgggtaatgttattttttgttataattataaattgaagaaaattgattgttttttttttttagttaatatgttgtgtttttagttttaaatatttttgagaagttgtttagatttatgagtaatgtttttgtttttaataggttaagatattaggtaggtttttgtatttttggagtttttagttttttgtaaagtgaggaagttagattaagtaattgttaggtttttttttagattgattaatttgatggtattagatgtaattgtttttgaattagggtatgaaatgaatttagttttggtgtattaatgtgatgattttgttttattaaagtttgagtatgtgataggtttagtattattttatatagagataaagggtaattttttgtttttaaaggaatgatataatttgtttttgaagtgatttatattatttttatttttgaataatttaatgtttagaaaataatttaagaatttttgttgattttagggatgtaagatatggttttttgatagtatttgggattgtggaaaaaagtaattgaggaaagggtatttttataatgtaatattgaatttagtgtttaaggtttattataggaatttttaatgatttttataattttttttttttttttttttttttttttttattttgaaaataaattgagaagttagtattgggataattattttttttgatttaaataaaaagttttgggtaaatataggtataaattgttaaatggaaaaagtttttttttatttttagttagagggaggttggggattttagttttttagaagttggtttgtggatgtttagagaatttttttggagattaggttagggttattgagtttgtttagtagggtgttgttttggatgttgttttgttttttattttgttagtgttgtgtttgggttgtgaaggtgtgtgtggtgtttggtgattggtggtggtttggagttgtttggttgttattggttgtttggttttttttgtttttgggtttgggttgtaggtttgttgtggtggattgggtggtggaagtttgatggtgttgggtgagtggttgttgagtggtgttgtgggagttttgtaggttttttgtgtttgtagtggagttggaggttagttgaatttggttgtgggattttggataggaggaggaggggatttataggatgtgttaatatggatttggaaaataaagtgaagaaggtaggggggtgtttgtggtgggtggtggttgttttatttgtgtgggttgtgtggtgtgtggtggttggaggtgttgaggtgggtggggtttgtgggttttttggtgtgagtttggttttgggtttgtggtgttttgggtttagggatttggttttttgggtagaggaggtgtttggtggttttgttagttttttatatttgggagtgatagaattggaagtgtgagtgagggtgggtgtgggatttttttttttagttttatggaattttagtggttgtaggtgttggaaattttatttaagatgttttagttttgtttgtgtttttttaaaaggaaaggatgagtttagggtgagtgtgggtgagattgtgatattttttggtttaggaagttgaattttattaagtttttgtggtttggggttttgttgtgttttgatagttttgatttttttttttttggttgggttgtttggggtgttttaaaatgagtgttgatttaatgtattgtttttgtatttgtgttggtgataatttttaatgtgattttttttttggttatttattatttgtttattgattgaggtagtgttttttttttagggaattatttgttaaagagtgtattttttttgtttggtaggtagttttaaagggtggttgttattagtgttttagtgtagggagatatttttagtttggttgttgttttgtaggtattggaattgatggttttatttgagttatttttgggttatgtggagtttggtgttgtttgggagaaaagggtggggattagattatgatttagaaggaatgttgatgttatatttgagtgaattgttttgtgtgaaagttttttttgttttaggggatttgtttatgttttattttgtggtaaatttaagttagttgttttttattaaatagagaagttttgtagagagaggaagggaaaaatatagaaaatagtttttgttttttttatatttatggtttttaatattttattttttaaatataaagtttttgatttgagtattaattttattttatgtttagaattggatttttgaaaatggatataaaatattgtgttaggattgtagagtttttggttaggaagttattgattaataaaaatttgaaatgagaaaatagttttttttattttttgtgattaaaatttttaggtatttaaaaaggtatttaagaatagaaaaatataaattgttaatggtagtgtgattgtattttattttttttttatttggttttttttttttttttttttaaataattgtaatatttttggttaattttgtttgttatgggggaaaagtggggaaagtattttgtttgtttagttttttgttgatgaatattatttttatttagtttttaagtaggtaagagttatttaatttagtatttgtttaaaatttggggggttttgtttttgtttttaagtatttatttgaagataattttgtaaaagtaaatatattttgggttgttgaggatgaataggtgaagtataggatttttagggtaatgatattattttgtatgatattataaaatggttgatatatgtaattatatattaattaaaatttatagaatgtagaatattaagagtaaattttaatgtaaattatgtatgttggggataatgatgtgttaatgtgttttattatttgtaataaatgtattgtattgatatgggttgttggtagtttgggaggttgttggagataggaaggtatgggggaggtatatgggaattttgaattttttgtttaattttgttgtgaagttaaaaaatgttttaaaaataaagtttgtttaatagggggagaaaaattaaagatatttttgaaattttttgagataaggagtaattttgagggaagaagtttaaatttaaaaattgtatatgtttgtaaaggaaaaatttagatgttgtttataaataatttttttagagtttgaaaatgtg

SEQ ID NO: 371 - DNA, 4448 bp, Artificial Sequence
  chemically treated genomic DNA (Homo sapiens)
tatatttttaaattttaaggaaattgtttataaataatgtttggattttttttttgtaagtatatataatttttaagtttgaatttttttttttagaattattttttgttttaaaaagttttaaaaatgtttttgatttttttttttttattaaatagattttatttttaaagtattttttagttttatagtaaaattgagtagaaaatttgaagtttttatgtattttttttatgtttttttgtttttagtagttttttggattattaataatttgtattagtgtagtatatttgttataagtgatgaaatatattgatatattattatttttaatatatatagtttatattagggtttatttttggtgttttatattttatggattttgattaatgtataattatatgtattagttattttatagtattatatagaatagtgttattattttaaaaattttgtgttttatttgtttatttttggtagtttaaaatatgtttatttttgtaaagttgtttttaaataaatatttaaaagtaaggataagattttttaagttttagataagtattaaattaagtagtttttatttatttgaaaattaaatgagagtagtatttattaatagaaagttaagtgggtaaaatgttttttttgttttttttttatgataagtaagattaattaaaaatattatagttatttaaaagaaaaaaagaaagaaattaaatgggaagagaatagaatgtaattatgttattattaataatttatgtttttttgtttttggatatttttttgagtgtttgagaattttagttgtaaggaatgaaaaaaattgtttttttattttgagtttttattggttaatagttttttaattgaaaattttgtagttttaatataatattttgtatttatttttaaaaatttagttttgggtataaaatagaattaatgtttaagttaaaaattttgtgtttagaagataaaatattaggaattatgagtatgagaaaaataaaaattgttttttgtatttttttttttttttttttgtaaaatttttttatttgataagggatagttagtttaaatttattataaagtaaaatatgagtaaattttttggaatgaggagaatttttgtatagggtaatttatttgaatgtgatattagtattttttttgagttatagtttggtttttattttttttttttaggtgatattaggttttgtataatttgggagtggtttaggtagggttgttggttttagtgtttgtgaggtagtagttaagttgaaaatgtttttttgtgttgagatgttggtgataattgttttttgggattatttgttaaataaggagaatgtgttttttgatagataattttttaagagggaggtattgttttggttggtagataagtaatgaatgattgaaaaaaaaattatattagaagttattattagtatgggtgtgaaggtagtgtattaaattaatatttattttagagtgttttagatagtttagttggaagggaggagattagagttgttaaagtatagtagagttttaaattataaaggtttaatgaaatttaattttttgagttaggaagtgttatggttttgtttgtatttgttttaagtttgttttttttttttgaggaggtataggtagagttgaaatattttaagtaaagtttttaatatttataattattgggattttgtgagattggagagaagagttttgtgtttgtttttgtttgtgtttttaattttgttgtttttgagtgtggggagttggtggggttgttgagtattttttttatttagggggttaggtttttgggtttggggtattgtagatttagagttgggtttatattggggggtttgtgagttttatttattttggtatttttggttgttgtgtgttgtgtgatttgtgtaggtgaagtagttgttgtttgttatgagtgtttttttattttttttattttgttttttaggtttatgttaatgtgttttatgggtttttttttttttttatttgggattttatggttgggtttagttggtttttggttttgttgtgaatatgggaaatttgtggaatttttgtggtgttgtttaatagttatttgtttggtgttgttgaatttttgttgtttagtttgttgtagtgggtttgtggtttggatttgggaataaagggggttgggtagttaatggtagttgggtagttttgggttgttgttaattattgagtgttgtatgtatttttgtggtttgagtgtggtgttggtaaggtgagaggtggggtggtgtttgaggtggtgttttgttgggtaagtttagtgattttgatttggtttttgaagggattttttgggtgtttatgggttggtttttaaagagttgggatttttagtttttttttagttgaagatggagaagaattttttttatttggtaatttgtatttgtgtttgtttaggattttttatttgggttaaggggaatagttattttaatattaattttttagtttatttttagggtaaagagagaaaaaaaagagagagagagagattgtagggattgttagggatttttgtgatggattttgggtattaaatttaatattgtgttgtggagatgttttttttttaattgtttttttttataattttaaatattgttaagaaattgtattttatatttttaaagttagtgaagatttttagattgttttttgagtattgggttgtttaaaagtaaagatgatgtgaattattttagaaataggttgtgttatttttttggaagtagagggttgttttttgtttttgtgtgagatggtgttaggtttattgtgtgtttaggttttgatgaagtagagttattatattggtgtattaaagttgaatttattttatgttttaatttaggagtaattgtatttaatattattagattggttggtttggaagggagtttaatgattatttagtttagtttttttattttgtagggaattgaggattttagaggtgtagggatttgtttaatgttttagtttgttggggatagaggtattgtttatgaatttaaataattttttaaagatgtttggggttggaagtatagtatgttgattaaggaaaaagagtagttaattttttttaatttgtggttatggtaaaaaataatattgtttagatagtaggtgatttaatttggtatttatttttaaaaataataaaataatataaaataaataaataaaaattttttaataatgtagatatttaggtttagatgtatgtttgttttgttttgagaaatttggtagttaaaaatatttaaaatttattttagttaatatttgtaattttgtttatttgattatttgttaatatagagtattgatttataatgtgtatgttttttttattttattaagaattaaaattgaaattattaaaatgagttatgtatttttttttttagttgatgtaaaatttttttgtgttatttttttaaattattttgaaaggtgtgggtttttgtaaagtttgtttgttgtaagtgtataggattatgaggtttagttatgataaggtaattttgttttttttagagagtttaatagatggaaaatgtttagtaaagtaatttaaataaggtattaaataaatgttgtaatataaattttggatttttatttgatgaggttgtagagatgatattaagaaaattatttggaaattttttttttttaattgttaatttttgttttttttttattttttttttttaatttttttagtattatattgtgtgtgtgtattattggtaaggatggaaatagaaatttagtgagttttatttggaattattattgtgttaattatataaaaataattatagattatgtataaattataaaaataaaattgaggtagataagtgttaagagagttaaattgtaagtttttgtttagttatttaggtgttaagttatagttattaaggaggtagaattggtatggtttgatgagtatatgtagttgatgatagtggaatgaatagaagatggtatatatttttattttgattatttttatggatagtttagaaagagagaaaatataggatgatggttagggttttgtttagttgtgtattttttggggttggtggtggatataaaggatataatttttaatatattgagtttgagattgagatattgaaatgagtatttaaatatatattttgaatgttgatttaggagtttatattttatataaataaataattaaaggttaagaagtgagatgagttttggagatagtaaaataaaagagaagaatattaaagatattaagtgagtaaggttgagtaagagaaatatataaaagagataag

SEQ ID NO: 372 - DNA, 4408 bp, Artificial Sequence
  chemically treated genomic DNA (Homo sapiens)
ttatattgtgagtatataaaaagtattatatggttaatggaggatgaggaattatggtaaagtaggtaggtaagttttaagaaataaaataatttgttaaaaaataatttttgatgattattgtaagattgaaagtgtaggaaaaatatagtttgaataattttagatttttttatattttttttttttttatatattttgttattttataataaaatttttaatggaaagtttaaaaataaatagtataggaatatgtgttttaaatgaattaaattgtgaaattagttagtaaattaatttgtagtaagtaattatttaaggaaattaaaatattgtttagtttagttttgtattttattatgtgtatgtgttttttataattaattaatataagtgttttaggaatatttgaagataaatatgtttaatttaaggaataaagtatttaaataatttaagtgtaattttgttgagttaaagtaaaatattttataaatgaagtggttatttaattttttagggaaagtttggttattgaaatgttgtatgtttatgttatattaataaaaatttttaatttattttgtttatgtgttttgtttttttgatattattggtatttgaattttagatggatttttgttaaaatgatattttgtgtgataaaagtatttttagttttgattgatagattaaaataaatgtaaggaaatttttttaaattagattaattttttataaaaatattttagaatgtatgaattttgatatttatatttataatggtaaaagttttttttgtttagtttagtaagataatatttatataaaagagtaaaaaaaaattatattattttatgatagtttgatttttaaattgtttaagaaagtaaagtggttaaattggaaaagaggaatatattttggaggtttagaattgaaaattttttttttaatttttagttggaaaataattttttgtatttatttaaagtgtattttttgaagtgttagattggagttgattggtgattaatttaaaggagttataatttaaagaaatggtgagagtttggtatttaggtttggtttttaggtaatttgtttgggtttgagaggttattaattgttagttaagatggaattttttttttttttttttttttttaatggataataatgggaagggggttaattttttagtagttgaaattttgtatttagttttttattttgagaatgttaatttttggtttgaggatttgtttttgtagtgttggtattgagatttaagggaagatattttgttttaaatgttagttatggtttggttttttttttgattttagtattttgtagattgttagtgtttgtggtgggggatgaaaggaatagggttttgtaaggtttgtttgttgattgtgttattttgggtgaaatttagttttaaaagttataaattatttatggtgaagattttttgaagtggaataaatttttagatttgtattattttatatttttgtgggatagatggtttttatttattggttattgggagagagttgttgtttttgtgttttattgttttttggggtgatttttagtgagttgagtttttggttgtatggtaagtgtttgaaagttgggtttgagaggattgtagggtttttgagggtgttaagttttgaaggagtttatgggtgtattggggtttttgaaatttagttgttattggtagtttttttttgtttttttttagtttttttgtttggttttgtattttttttttttttttttttttttattttttttttttttttttgtttttattttgtgtggggagtgatgtgatgttagtagagattttattaaattttattgtatagtggtgtgtgggtggttggttgagtttggttgtgtggttggtgatttaggagtgagtatagtgtttgggtgagtgttggggggagtgagtaggggtgatgagaaatgaggtaggggagggaagtagatgttagtgggttgaagagttgggagttggagttgggagagtgaaaggagaggggatttggtggggtatttaggagttaattgaggagtaggagtatggatttttattgtggaaaggaggattagaagggaggatgggatggaagagaagaaaaagtaatttgtgttaatttggtagttttaataaattaaagggggagtgttagggtagtggggagatagaaatgtatttttggggagtaaattaggatgggttgggaggaagtgatagggaaagtggtttaagagatggaataaaggataatgtttatggggttgtttgggatgaggtgtgtggagtgtgggtgtgagtgtgtgtgtgtgatttttttttaggtttgtagagttgaggaaagaggttatagtaaagagggattgtggagggaggaaagtgagagattggtagagggtgggagtggaggtgggtgtggtggggatgggagaggatgagtgaagagaaatttagaagaatggagtgagttagtgggagagggtgggagggttatagttgggagtgaatgagttaggtttgttagttggggaaggttgggatgttgggtttagtttagttgggatattgtgtttgaggttaaggtgggtggattaggtatgttgagagtgttggtgtataggtgggtatggttatgtattgatttagtgtttatgaagggtttgtattggataaggtttagatgtttatagagtttagaattttttttgttgtatttatatttaataagtttattttgggttatggatattttattttttaaaatgatgaggttaaggtttttggtgaggatggtattaaattgtatgggatagaagtgggggtgggggagagagttttttttaagtttatatttgtttttgtaaagtaaagagtatgtgaaattatagggtatatttttatttgaaaagtgtgttttatttttgaattttgattttttgattttttgatttgagtaaagatgtgtattttggtagtgagtagaatattttggttttgttttgtttttgagtggaaggattataaatataatttgtttggaggattaggtgtgaaggtttttgttaggtatatgggataatgtttttttaattttaagggtattttgttaatgtatgtttttggaaagtgttggaatatagttattgtttttggatttggatttttttattaatattaatttttgtttgagagtaaaatttaggtttgttattaaaaagatatttttttggtttttaattgagaataaagttttttttaaaagttgtattgttttttttaaattaatatattaatatttgtaattttagaaatatatagtgatttgggagaatgtgtataaaatagatatgtttaaaaaagtttggtgtttaaaattaattttagttattatataggtgttgggttttttttatttttgggggttgtttggaatatgttatgtgtttttttgaattattttgtgttttgaatttatttgagttagtagtaaaaataggtaaataaatttgtttaatttgttttgagtgttaaatttttttattttgaaatagttaatagttgatagatggatttattttatggaaagggttagtttttttagttatgaagaaaattgattagagatttatattttaagttatttttaatttttatgtaatatttgtgaaaatttaaattttttttttttatttagtggaaatttaaagtagtgttatttaaggggagagaaatgagggggaaaatgtttatgtgttgtttaattgtattttttttttgattttgagaatttttatttttggtttttgaaattttgttgaggtaagaaaattaaatttttttaataagttttataattgaattttagttataggatattggaaagtgtagtttgagaaagatatttttatttttgtttattgatgatttttgtagtttttttatttttttgagtaatgggttaataattttttttttttttttttttattttgtagagattaagaggtgtttgtagtagaatggttttgtttttagttggtggtgaggataggtaattttatggaaaagttggaagagaatgagaaaattaaagatagaaagatttagagatttgtggagagatatagggagagggaagggagttgtgttgaaaagatgtaaagatatgtgtgtgtaattttttttttttttaggttttagaggtttgtaaattagggttgagaggaaggggtttgggaagtttatgttttttttgttttttttttgtttggagttttgtttgttagaggttggttaattttagttttggttgttgtagatattgtgttgagtttttgggttt

SEQ ID NO: 373 - DNA, 4408 bp, Artificial Sequence
  chemically treated genomic DNA (Homo sapiens)
ggatttaaaagtttagtgtagtgtttgtggtggttgggattggggttaattagtttttggtgggtgagattttagatagaaggggggtgagaggaatgtgagttttttgagttttttttttttagttttggtttgtaaatttttgaaatttgaaaggggagggagttgtatgtgtgtatttttgtgtttttttagtgtaatttttttttttttttttgtgtttttttgtggatttttgaatttttttgtttttggtttttttatttttttttaatttttttatgagattgtttatttttgttattagttgaaggtaaggttgttttgttatgagtgttttttaatttttataaaatgaaaagaaaaaaagggaggattattagtttattatttagaggaatggggaggttgtaaaaattgttgatgggtagaggtgaagatgttttttttggattgtattttttggtgttttgtaattagagtttagttgtgggatttgttgaagaaatttgatttttttgttttggtgagattttaaaaattagaaatagaaatttttagagttagagaggaaatataattaaatagtatgtgggtatttttttttttatttttttttttttaaataatattgttttgagtttttattgggtaaagagagaaagtttgagtttttatggatgttatgtggaggttagaaatggtttaaaatgtagatttttaattagttttttttgtggttgaagaggttaattttttttataaaatgagtttatttgttgattgttagttattttaaagtgaagggatttagtatttaaaataaattgagtaagtttgtttgtttgtttttattgttaatttaaatgaatttaaaatatggagtaatttaagaaaatatataatatgttttagatagtttttaaaagtagggaaagtttagtatttatatagtgattagggttagttttaagtgttaagtttttttaaatgtatttattttatgtatatttttttgagttattatatatttttaaaattgtgagtattggtatattgatttaggaagagtaatataatttttagagggaattttatttttaattagggattaaagagatgtttttttaatagtgggtttgagttttgtttttaagtaggaattaatattggtgggaaaatttgaatttaggagtaatggttgtgttttggtattttttaaaaatatatattaataggatgtttttgagattgaaaaaatattgttttatatgtttggtagaagtttttatatttggttttttaggtgaattatatttatagtttttttatttagaggtaggatagagttaaaatattttgtttattattaaaatatatatttttgtttaagttaagaaattagaaaattagggtttagaagtaaggtatattttttgagtgagaatatgttttgtaattttatatattttttgttttgtaggagtaaatgtggatttgagggaaatttttttttttatttttatttttattttgtgtaatttaatattatttttgttaggaattttaattttgttattttaaaaaatgagatatttgtgatttagggtgaatttgttgaatgtaggtatagtagaggaaattttagattttatgagtgtttgagttttgtttagtgtaaattttttgtgaatattgggttagtgtgtggttgtgtttatttgtgtgttgatatttttagtatgtttggtttatttgttttgattttgggtgtggtgttttagttaagttgggtttagtgttttggttttttttagttgataagtttagtttgtttgtttttggttgtggtttttttatttttttttattagtttattttatttttttagatttttttttatttatttttttttatttttattgtgtttatttttatttttgttttttattggttttttatttttttttttttgtagtttttttttgttgtgatttttttttttaattttgtaggtttgaaagaaggttatatatgtatgtttatatttatattttatatgttttgttttaaataattttatgaatattgttttttgttttgttttttgggttattttttttgttgtttttttttagtttgttttgatttgttttttaaaagtatgtttttgtttttttgttgttttggtgttttttttttgatttattagggttgttgggttggtgtagattgttttttttttttttttattttatttttttttttggtttttttttttatagtgggagtttgtgtttttgttttttggttggtttttaagtgttttgttaggttttttttttttttgtttttttggttttggtttttgattttttggtttgttggtatttgttttttttttttgttttgttttttgttgtttttgtttgttttttttggtgtttgtttgggtgttgtgtttgtttttggattgttagttgtgtagttgggtttggttggttgtttgtgtgttattgtgtagtggagtttggtggaatttttgttgatgttatgttattttttatatggagtaggagtagagggaagagagagggatgagagggagggagaggagagagagtgtgagattgagtgagaaagttggagaggagtagaaagaaattgttagtggtggttagattttggaggttttagtgtatttgtggatttttttggaatttggtatttttaggagttttgtagtttttttaggtttggtttttgggtgtttgttgtgtagttggaggtttggtttgttggaaattgttttgggaagtagtgggatgtggagatagtagtttttttttggtagttggtaagtggaggttatttattttgtagggatgtgagataatgtgagtttggaaatttgttttattttggagaatttttattgtaggtgatttgtggtttttggggttaagttttgtttaaggtaatgtagttggtaaatagattttgtaaagttttgttttttttgttttttgttatagatattaataatttatagggtgttgaagttgagagggaagttagattgtggttggtatttaaaatgaggtatttttttttaaattttggtgttaatattgtaggaataaatttttgggttaaggattagtatttttaagataaagggttgggtataaagttttagttattggaagattagttttttttttattgttatttattgggaaaaaaaagaaaagaaaaagattttattttaattggtagttagtgattttttaggtttaagtgaattatttgggagttaggtttggatgttaagtttttattatttttttggattgtaatttttttaaattgattattagttaattttaatttggtattttaggagatatattttaaatggatgtagagaattattttttagttggagattaagaaaaaaatttttgattttaaatttttgaaatatgttttttttttttagtttaattattttatttttttaagtaatttagaaattaaattattataaggtggtgtgatttttttttatttttttgtgtgagtattgttttattaaattaaatggaaaaaatttttattattataaatgtaaatattagaatttatatattttaaaatatttttatgaaaaattaatttgatttaaagaaatttttttgtatttgttttagtttattaattaaaattaaagatgtttttattatataaaatattattttggtagaaatttatttaaaatttaaatattaataatattaagaaaataaagtatataagtaaaataaattgaagatttttgttgatgtaatatgagtatataatattttaataattaaattttttttaaaaaattaaatagttattttatttgtggaatgttttattttaatttagtaaaattatatttaaattatttaggtgttttgttttttaagttaagtgtgtttgtttttaaatgtttttaaagtatttatattaattggttgtaaagaatgtatatatatggtaaaatatagaattgaattgagtagtattttaatttttttaaataattatttattataaattaatttattggttaattttataatttagtttatttaaaatatatgtttttgtgttgtttatttttaaattttttattaaagattttgttatggggtaataaagtgtatgaaaaggggggaaatgtgaaaggatttgggattatttgaattgtattttttttgtatttttagttttgtggtagttattagaaattattttttagtaaattgttttattttttagggtttgtttgtttgttttgttatggttttttgttttttgttagttgtgtagtgttttttgtgtgtttataatataa

SEQ ID NO: 374 - DNA, 4435 bp, Artificial Sequence
  chemically treated genomic DNA (Homo sapiens)
gttttttttttggttgttatggtttatgttattaatttatagttatttttttgtttgttatggttttttgtttttggtttatgaatttttgggttgtttagattggggttgggggtggttgaattgggggtttaaagttatttatatgaaattgtatgtatttttgttagtttggggaagggagttgattttttggagatttagaatttagaagagagatttttagtaagtagtgggggtggaatttgtgtttttagtgtttttaaattttttttgagttttgtgatgttttttaatttttgtttgtaattttttttttttgttagttttggtgggttttttattggtgtatgagtgggatttttagattttgagtagtagtaagatgatggtgaggaggtgggagaggttttttaggaattggaagagatttatggttggggaattttggtagggttgagtgggagggaggtaggttggtgggggggtgttttttgaggttgttggtttgaatgggtagttgggttggggggatggaagagggattttaggtgtgttttgttttggggaggggattttgggagggggagtaaaggttggagttggtggtggagttggagttgggaagagggaggagagtgagagggggaggagtttgggaggagaggttttgtttttgagggtggggtttggatttttggtgttttttattgtttattttttgttttgttgtggtggtgttaaatgtatttttaaagttgttttataggaatttgggagggttgtagggtttggaaagtgttaaatttagtattggtttgtttaggtagtttgtgtttttggaagagatgtagtttagtatattagttttagtttttgtagggatgtagagattgttttttgagtttgaaaaattttgtagggatttggaggtttagttgttagtttttgtagtttttaggtattttaattttaattttttagaagataagaaagatattttatttatttttttttttagatttaggatttaaggttttagtttgtttgttaaatttagaagtttgggtttttagtttttttttttttagatttaggagtttagatttttagtttttttttttttagatttagaagtttagatttttagtttttttttttttagatttaggagtttaggtttagtttttttttgtttagatttaggagtttaggtttttagtttttttttttagatttaggagtttaggtttttagtttttttttttagatttaggattttaggtttttagattttttttttttagatttaggagtttaggtttttagtttttttttttttagatttaggagtttagatttttagtatttttttttttagatttaggagtttagatttttagtttttttttttttagatttaggggtttagggttttagtttttttttttttagatttaggggtttagggttttagtttttttttttttagatttaggggtttagggttttagtttttttttttttagatttaggagtttagggttttagttttttttttttttaggatgttgttttttggaatttagggttttatttttattattttatggattaaatattttaattttaagaatttagatttatagtttttttttttatgatttatagatttaggttttgattttttttttttttaggaatgtgtattttattttgtttttttagattttgaggatgaaggaaataggagttttatttaggaggtttaaggttaaaattttgatttaaattattttaggagtttttggttttggttttttttttgttttagagtttttgttttgtttatatatatatatttttttttatttttagaggttttggtgttttgttttatgttttattttagagttttatgggtggttttataaaagtgttgggtttagttttttagtaggaggggaatgttgggtatttgggtgtgggatttttggggaatagtttgtggtttggatttttgtatttatgaggggatagatgtggttttttttttggatgatggggtatttatagatgatggaggttagggttttttaataaaagaaggggtgtaggtgtgttgatttttttagagggttggaaggatggggtgtttaagggtgatatttatgagttttgggtttttgagggtggtttgtatgggggagagttgggatgattgagtttttaaaagagattttgatttggaggtggtttttaaatttttgggttttagtagagaaggggatttttgggtttgagggaggaggggttggggggtgggatttttgggattagggttgagatttggtttttaggtttggttttttggggtaataaaagttatagtttgggttttagtgtggtgaatattgaagttagggaaaggttttttgtttttagagttttaaggtagggtgggggtagagggtagtaatttttagttttggagtttagttttgaagttggtgtttttatattgggttttgagtttttgtttgtttgtttttagtttgatttttttttttttttttatttttagttttttatttttttgttttaggaggaaggtagaggttggtagttaggggtggggggtggttttttttttaagtttggtaggagaaggggtttttagggaggttaggagggggggttgtgggttttttggtagtggtagatggggattgaatgttaattgtattttgagtgagtgtgtgtgtgtgagaatatagtgagtgtgtgagttttttttgttttagtttttttaagttgtggttgttgttgttatttttgtttgtagttttttgtagttttttttggttattggtgtttgttgggggtgttgtttgggtaggttggtttggtttttaggggttttttgagtgtttgttatttgtttggtgaggatttgtgtgtttgggtgtttggggttggttggtggagggggggtgtgtttgtaagtgttgtggtggtggagggagggaggggtttgtttgtttgtattgattttgagttgtttgtttgggtgttgtggggtttttgttttttttttttggtttttttaaatttagatggatggtgtgtatttgggttttgtgttttttgtttgtgtttggttaggtgtttgggtgtttttggttgtttgtgtttttttgtttgtttaaatagtttttattagtagtggtagtttggtttttattagattttttattttgtgtgtgtgtgtttgtgtgtgtgtttttttttaagttttgggggtgttgagggggaattttagggaagtgagattgtgtgtgtgtgtgtgagtgtatgtgtgtttttgtttgtgtttgagagtgggggagttaagggggggtttagaggtggttaagtgaggaaggggtaagtagttttttaagtaggtaattttttgttttttatatgtatatattagttattagttttagaggtgatttagatagatagatagatatagatgttggaagggggggtgggggggttgagggtataaagtgggggtgtgagtgagttagggagaggtgggattggatatatggaaaggggggaggagttggggttgaagtggtagaggggggtattttgggtgggtggaggggggatttttatggggttggggtggtaagaggatattttgatagtttttgtaatgtttggggtttaatttttagagtaatatgtgtagttatgtttttgtttagtttaggtggttgtaattttgggggagagatagggtaggataggattaaggaagaggaaggagagatggagttagggatagataggaggtttgggttgttgttgttgttgttattattattgttgttgttttggggtttgttttttgatattggttttttgagttttttttggaattttggggttgttggatgttgggttttggttttggtttttttgttatttttttaatagaatagggttatgaaaaggtaaggtggggataggggatgtagggatggtggtgggaatgtggatttttaaatttaggatagaggaagttggtaagaagttttgtggagggagggggtttgaatggtgggtaggggttttgatttttatttagtttttttgttttttagggatttttttttattttttttttttttttttttgagttttttttttttgagtttttatattttagattttttatgtttttatttttttgatatttggttttttttttttatttttatatatttgatgttttatatttttgtgtttttatttttttattttattttttttttgtatttttttttttgtattagtttttttattgtgagttggttttttttttttttttttttgttttttttttttatgttagagttatgagtttgttattaat

SEQ ID NO: 375 - DNA, 4435 bp, Artificial Sequence
  chemically treated genomic DNA (Homo sapiens)
attaatagtagatttatagttttgatatgggaggggagagtgagaggagagagggagaggattggtttgtgatggggggattgatgtagggaggggggtatagggagaaggtgagatagagagatggaggtatagggatatggggtattaggtatgtggggatggggagagggagttaagtgttagagaaatgggggtgtgaaaggtttgaggtgtagggatttaggaaaaaggggtttagagagggagagagagagggtggaggagagtttttgagggataggggagttaggtgggggttaagatttttgtttattgtttaaattttttttttttatgaggttttttgttaattttttttgttttagatttgggggtttatatttttattattatttttgtattttttgtttttgttttatttttttatgattttgttttgttggggggatggtgggggggttaggattggaatttggtgtttagtgattttaagattttgaggagggtttagagagttgatgttggggggtaggttttggggtggtggtagtggtggtggtggtagtagtggtagtttggattttttgtttgtttttggttttgtttttttttttttttttttggttttgttttgttttgttttttttttaaggttgtggttatttggattaggtgaggatgtggttatatatgttgttttggaagttgggttttggatattgtagaggttgttggggtgtttttttgttgttttgattttgtggggattttttttttgtttatttggggtgtttttttttgttgttttagttttggttttttttttttttttatgtgtttagttttgtttttttttggtttatttgtatttttgttttgtgtttttagtttttttatttttttttttagtgtttgtgtttatttgtttgtttgggttatttttgaagttagtggttggtgtgtgtgtgtgaggagtgggagattgtttgtttggggaattgtttgttttttttttgtttggttatttttagatttttttttgatttttttatttttaaatataggtagaaatatatatatatttatgtatatatgtatgattttatttttttgggatttttttttaatatttttagagtttgaggagggatatatatatagatatatatatatagagtggggggtttaatgggggttaggttgttattgttgataggggttgtttggatagataggaggatataggtagttggggatgtttagatgtttggttggatgtaggtaggaggtatagaatttaggtatatattatttatttgggtttgggggggttggggggaaggagtgggagttttatgatatttaggtaggtagtttagggttggtatagatagatagatttttttttttttttgttgttgtagtgtttatagatatattttttttttattagttagttttagatatttggatatatagatttttattgggtagatggtagatgtttgagagatttttgggggttgggttgatttatttaggtaatatttttagtaggtattggtggttgagggaggttgtgggaggttgtgggtgagggtggtggtggtggttgtggtttggaggagttggagtgggagggatttatatatttgttgtgtttttgtatatatatatttatttgggatgtgattaatatttagtttttgtttgttattgttgggagatttatagtttttttttttggtttttttggggatttttttttttgttaggtttggggagggggttgttttttatttttagttattagtttttgttttttttttgggataagggagtgaggggttgaaaataaaaagggaggaagaagttaggttggggataggtaggtagggatttagaatttggtatggagatattagttttagagttagattttagggttgggggttgttgttttttgtttttgttttgttttgaggttttggaaataggaggtttttttttgattttagtgtttgttatattaagatttaagttgtggtttttattgttttagaaggttaggtttgaaaattaggttttgattttggttttaggagttttattttttagtttttttttttttagatttaggagtttttttttttattgggatttaggaatttggggattgtttttaagttggagttttttttaaggatttagttattttgatttttttttgtataagttatttttagggatttaagatttgtggatgttatttttgggtattttgtttttttagttttttgaagaaattaatatgtttgtatttttttttttattgagggattttggtttttattatttgtgggtattttattatttggaagggaagttatgtttgtttttttatagatgtaggagtttagattataggttgttttttgggggttttatatttagatgtttagtattttttttttgttagagggttgggtttggtatttttataaagttatttgtggggttttggggtagagtgtggggtaggatattggggtttttgagggtggaagagggtgtgtgtgtgtgggtagggtagaaattttggagtaggggggaagttagggttaggggtttttgaggtagtttgggttagagttttggttttgagttttttgggtgaggtttttgttttttttatttttaaggtttgggagaatagggtgaggtgtatatttttgaaaaagaagagaattagggtttaaatttgtgggttgtaaagggagaaattgtagatttagatttttaaggttaggatgtttgatttataagatggtgggggtgggattttaagttttaaggaatagtgttttaggagggaaaagggttggggttttgaatttttgggtttgagggaggaggggttggggttttggatttttgggtttgagggaggaggggttggggttttggatttttgggtttgagggaggaggggttggggttttggatttttgggtttgagggaggaggggttggggatttggatttttgggtttgagggaggaggtgttgggggtttggatttttgggtttgagggaggaagggttgggggtttggatttttggatttgggggaggagggtttgggggtttggagttttgggtttgagggaggaggttgggggtttggatttttgggtttgagggaggaggttgggggtttggatttttgggtttgagtgaggaggagttgggtttggatttttggatttgagggaggaggggttgggggtttggatttttgggtttgagggaggagaggttgggggtttggatttttgggtttgagggaggaggggttggggatttagatttttgggtttgatgaatgggttggggttttgagttttgggtttaggggaggaagtaggtggggtattttttttgttttttgggggattggagttagagtgtttgaaagttgtaaaagttagtagttgagtttttgggtttttgtaggattttttaagtttagagggtagtttttatatttttgtaagggttgaggttggtgtattggattgtgttttttttagagatatagattgtttgggtgaattggtgttggatttggtattttttgaattttgtgatttttttaagtttttatggggtagttttgggggtgtgtttagtgttgttatggtaaagtaggaggtgggtgatagggggtgttggggatttaggttttgtttttgggggtggagtttttttttttggattttttttttttttgtttttttttttttttttggttttagttttgttgttagttttagtttttgtttttttttttaaagttttttttttggagtggagtgtatttagggttttttttttgtttttttagtttagttatttgtttagattagtagttttggggggtatttttttgttagtttgttttttttttgtttagttttgttagggttttttagttatgaattttttttgatttttgggagattttttttatttttttgttattattttgttattgtttaaaatttggaagttttgtttgtgtgttggtgagaggtttattagggttggtgaaggagagagattgtgggtgggggttgggggatgttgtaggatttaggaagggtttgggggtattaggggtataggttttatttttattgtttgttggggattttttttttaggttttgggtttttaggggattagtttttttttttagattggtgggggtgtatatagttttatgtgaatggttttaggtttttaatttagttatttttagttttaatttgggtagtttgagggtttatggattgggaatagggaattatggtaggtggggaggtggttgtgagttggtgatgtggattgtggtggttaggaagggaat

SEQ ID NO: 376 - DNA, 6001 bp, Artificial Sequence
  chemically treated genomic DNA (Homo sapiens)
gggtatagtgtgaggaagaaatatggaaaagatagattttttttagattgaaaaggagattgtttaggggtgggaggaagataaatagaggttagtgggttttgaggttgattgtatgtgtgatttgtgtttttgaaatattattttggaaattgtaggatttttgggaggaatggttgtaggggatgttttagtagatgagataatagttattgttattttattttaaatttttgtgtttttagtgggatatagaagtagtaggttgtttattaatttaagtagttatattagtttgggtagtggaaataatttagttatattttttgggaatagaggattaaatggatgtgttgtttttttttttaatttattatatgggattgtgtatagttttggtgttaggaattaattttaggaaggatgaaggttgatttttttagtttttagtagataagttgttaggggtagttattaatatataataattgagttatttatgtaaaataatggatatgtgatgttttttgtatgtttgagtttttgggttgagatttattttgttttgaatgttgtggtttttttaatgaagttgttgaggaatgtaggggttttgtttattttgtttttttttggaaattttgttttttaatttttagatttagagtagtgtttttgtttttagttttatattgtttatatttttattaggaaaagtaaataaaagttaaagttttgtttagttataagttttttttaaatggggtagttggattgtatatatttttggtgtattaattttatttagatagggaaaatatttttatattaaaagaaattaggttaaattatggtagagaatgtaaaatttatagtttaaaaatgatgaaattttagattttaaaggaattttttttttgtagggtagggggagggtattttgttttagaattttatgtgggtttttattggagtttttttgagaaggatatttttgtggaaaagtttgagtagttttggttttgtgtttggtttggttaggggttatttttttttggtttgggttgtagtgttttatgggtattgtgtttttgttaatatttttttatgtttttaaatttatagtttgttagtgtgggtgtaatttgagagttgttgtaggtttttagtttatttgttttttaaaggaggaaatggagaattagtgattttaaaggatttgtttggtgggtatttatgttttttaggttattgtttttttttgtgtttttggttatttttgttttttaattttgtaggaatttaggatttatgtgtaaatataaagaattgtatttatttatttttggtttttttttattttgtgtttttaattttgggggggttttttttttttattggggtatttgatgtttgtggggggtgtttagaaaagtttggtagattagtgattggtggttttggaataaatatattatagtttaaattgggggttggtggtggagaggtgggtggatgggggttataaatttgtttggtaattgtttttttagttaagagagaggagttgaggttttttggggttggaggattggaattggttagattgtgggtttaaggggtgaaggtaggttggtaggggtagtttttttttgttgtttataatttttgggtgggtgtgtagttgagttggtttggttggttggtgtaattttgtgtgttttttgtattgattaaaaatgggggttgaaatagtaaatgtgaggaggagtaattgttttgatttggtttagaagtgtgattaatggggatgtgagtttttttgtgtgaattaattagtgtagggtttgtgatagtatgggttaatggggtgttgatttggtgtaggaataaggtgggggtttggggttggttgtagatttttattgtagtggttaggaatgttagttgtttatgtgtttggttttttttggttgatttattgttttggttgttgtattatggatgtttttaggtaggtggttaattttgggtttggttttgttaagttgttgtatttagtaagtttttgtgagtgggtgttgggagtgaggtttaggtgggagtatgtatgtgggtgggtttgtatttttgtgtgtggtagttggatttttgttttttgttttgagttttttaggtgttttgtattagtgtgtatagtgggattagtagttttggtaagtgggttttgggaagaatgtagttggtgaggaagtttggtgaggtgtgtttgtgtagttgtttttggttttgattgttggtgtgaggtagtgtatgatttagttggttggggtttgttgttttgttggtgttatgtatttgtagatgtttgggttgtgttattttttgggttggtttgggggttggggtggggtgaaaaagaaaaagttttgatttttgtttttgttttgtgtagttgtgtggtgagtttgggtagtgtggagtggatgtatgaatggatatagtgtgaatgagtgatgaatgggaatgaattgatgataggttttgtatatgtagtggattatgttagttgaaagggattgtaaatttaaaggtttgtgtgtgtgtgtttttttatgttttatattagtgtttgttttagttagtatttaggaatattgttttttagaaatgtaaatttgaaaatttttagtttagtttttttttttttgttttttatagaatttatttttttttaaagtttttttttttattttttttttttttttaatttgtttgttttttaaaggtgtttgagtattttaattttggtagattttgggttgtttaatttaattttttgtttattttgttttggagtaaattgagtgattgaatttttttttgggttataattagattttgttggtggaatttattttttgtttttttaggttttagtttggtttttttttttttttgttaaatttattgtttttagttttatttgtagtgaagaaggtaaagtttttgatgtgttttgagtttattgttaggtggttgttgttgttgttagatttttatttttttaattaggatagagttgataatatgttggagtagtatgaggtatagttaagtattttataattattaattgttgagtagagtagaaatttttttgggatagagttttttttgtgttgtggtaagaatagagaatttaattttaaaggggaaaggattttttatttttttaggggtagtgtttatagtagttgagaggatagggtttatttttttttagtggttatagtttattttaggtgagattttttgttttagttgtggagatgttttttgtagtttttttttgtattttttatgttttggagtgtttttaatgtttgttttttatgtattttgttattaatttattattataattgtaatggtaattgttattagtaatataattatttgttattaatttttttgggaggatttttgtttttggattgtatgtaatttggggggtaggagggtgagggggtaggtagatgttgttttttatgtatttttttgatttagttgaattgtaaatattagagaagtttttaaattttttttgattgtaatttatagtgaaaaatatgtttataaaatgataaagtatatatatttaattgtaataaaaataaatgttttatgaaatgatgtgtagtttaattatttgtgatatatattattttgtattttattttgttttagtttgttttgttttattaaaaaaattagttgtgagttgggtgtggtggtgtatgtttgtaatttaagtaatttaggaggttaaggtgggaggattttttgagtttaggagtttgaggttgtagtgaattgtgattgttttattgtattttaggttgggtgatagagtaagattttgttttttaataaaaaaaaaaaaaaaaaaaaaaaaaaaattggttatgatttataaaagtaatgtattttttaattggaaaaaaaaaaatttattggattagggaggtgtgattttttagtaggagtttttaaaattgtttgtaattattttggttataaatttttatagaattatttttaatgaatgttgtttataagaaagatatagttttaggagtaagtttaaagattatttatagatgaatgtttttttttattaaaagaaaagatttattttattttatttgattagttggtgttaataagtatttaatattttagaaaataataatatatttttagatttagttgttaaggtagttttttttttaatttaatttttttttttttttttttttgagagaagttaagttttgttatgaggttggagtgtagttgtttggttttggtttattgaaatttttgttttttgggttttagtgatttttttgtttttgttttttgagtaattgggattataggtatttattattaagtttagttaatttttgtatttttagtagagatggggttttattatgttggttaagatggttttaattttttgattttatgatttgtttgttttggttttttaaagtgttgggattataggtgtgagttattatgtttggttttgtttaattttttattgttaaaatattgttttttgagataagttgtaatttagtttaggttatagttgtgttttaatgatgttttttttagtaagtattttaaaaaaaaaggtgttttttatttgtagattttttttggttggttgtttttgtatttattttgtgtttatttttaaagtttttttttttttttttattttttattaagggaatttttatatatataaagataaaagtagtgtaatgaatttttaaggatttatttttgagatttaataattattaatattgtgttagttttgttgtagtattttgggatgaattttatttatagtaggtttttttttttttttgtttattttatgttttttagtttagtattttagattaaaagagattggaaaattgagttatttgtataatttgggtataatttttttattgttgtttttttaatttagaattttatgtattttttattttagttttaggagagtggtgaatgagatttgtgaaggggatattttttagggaattggtaaatttgggtttttggaaaaagtgtattaatattagttatattgtttaattttatgtttattttgtgtgtaagttgtataattgttggttttgtggatatgggaaggaaggagattggttgtgggtggggatggaagtttggggattttattgtagatttttttttgtttttttgttaggtttgtatgtttagagggaaagtagtgtagaatatatttaaataattttatttttttttatttttttttaggtgttgttagagatataaaaggaattattagattataaaggagttggtattagtgtttttggtaagatttatttttgaattttgtgaatgtttatgttttaaaggaagtttttttttttttttttttttttagaggtagggttttgttttgttatttaggttggagtatagtggtgtgattatagtttattgtagtttttaatttttgggtttaagtgatttttttgttttagtattttgagtagttaggattataggtatatattattatatttggttaattttttttaaatgtttaaaatattttttaaagattttatgagatgggattttattttgttgtttaggttgatttgaaatttgtggtttgaagttatttttttatattggttttttaaagttttgggattataggtttgagttattgagttttggtttaaagggaattaatttaaatgtattaaatatagaattatagggtttatagggtttttttataggtttttatagatatatttttaaattttaatagtttgggttgtatgtttgatagaaattattttgaaaatagtataaatgttggtgagaggttttgatattttagtttatt

SEQ ID NO: 377 - DNA, 6001 bp, Artificial Sequence
  chemically treated genomic DNA (Homo sapiens)
ggtaagttgagatgttagaattttttattagtatttatgttatttttaaaatggtttttattagatatgtaatttaagttattaaagtttaaaaatgtatttataaaggtttataggaagattttataggttttgtaattttatatttgatgtatttaaattagttttttttgggttagggtttagtggtttaagtttgtaattttaaaattttgggaggttaatgtgggaggatggttttaggttatgagttttagattagtttgggtaataaagtgagattttattttatgggatttttaaaaaatgttttaaatatttaaaaaaaattagttaggtgtggtgatgtgtatttatagttttagttatttaggatgttgaggtaggagggttatttgagtttaggagttggaggttgtagtgaattatgattatgttattgtattttagtttgggtgatagagtaggattttgtttttaaaaaaaaaaaaaaaaaaaaaagttttttttgaaatatggatatttatagaatttaaaagtaaattttattaagaatattaatgttaatttttttgtagtttaataattttttttgtatttttaataatatttagaaaaaaataaaggaaaatagggttatttaaatatgttttgtattgttttttttttgaatatataaatttgatgaggggataaggaagggtttatagtgaggtttttaggtttttatttttatttatagttagttttttttttttttatgtttataaagttagtgattatgtaatttatatataaggtaagtatgaaattaggtaatgtgattgatgttgatatattttttttaaaggtttgaatttattgattttttagaaaatgttttttttataaattttatttattatttttttaaagttaaagtaaagaatgtataaagttttgggttaaagggataatgataaaaaaattatgtttagattatataggtaatttaattttttgattttttttggtttaaggtgttagattgggaagtgtggggtgggtaggaagaaggaagagtttgttgtgaataagatttgttttagggtgttgtaataagattggtataatgttgataattgttgagttttagagatgggtttttggaggtttattatattatttttatttttgtgtatgtgaggatttttttaataaaaaataaagagaaaaagaaaagttttaaaaatgaatataaaataagtgtaaaagtaattagttagagaaggtttatagataggaggtatttttttttttaagatgtttgttaaggagggtattattaaaatatagttataatttaaattggattgtaatttgttttaaaaaatagtattttaataataaagaattagataaggttgggtgtggtggtttatgtttgtaattttagtattttgggaggttaaggtgggtagattatgaggttaagagattgagattattttggttaatatggtgaaattttgtttttattaaaaatataaaaattagttgggtttggtggtgggtgtttgtaattttagttatttaggaggtggaggtagaagaattgttggaatttgggaggtggaggttttagtgagttgagattaagtgattgtattttagttttgtgatagagtttgattttttttaaaaaaaaaaaaaaaaaagaattagattaaaaaaaagattgttttgatgattgggtttaagaatgtgttattgttttttgaaatgttggatgtttgttagtattagttgattaaataaaatagagtgaatttttttttttagtaaagagaaatatttatttgtgaataatttttgaatttgtttttgagattgtattttttttatagatagtatttattgaaaatagttttataaaagtttataattaaaataattataaatagttttaaagatttttattgaaaaattatatttttttaatttagtaggtttttttttttttagttgaagaatgtattgtttttgtggattataattaattttttttttttttttttttttttttttgttaagagatagggttttgttttattatttagtttggaatgtagtgggataattatagtttattatagttttaaatttttgggtttaagagatttttttattttagttttttgagttgtttggattataggtgtgtgttattatatttagtttatgattaatttttttaatgaaatagaatagattagagtaggatagaatataaaatagtgtatgttataggtaattaggttatatattattttataaggtatttatttttgttataattgaatgtgtatattttgttattttgtaaatatgttttttattgtaggttatagttaaaagaagtttgaaagtttttttaatatttataatttaattaaattaaggaaatatataaaaagtaatatttgtttgtttttttatttttttgttttttaggttatatgtagtttaagggtaaaaatttttttagaaaaattaataataaataattgtattattgatgataattgttattataattatagtaataaattaataatgaaatatatagggaataaatgttgggaatattttaaaatatggggggtgtaggaggaggttataggaaatatttttatagttggagtagggaattttgtttaaaatgaattgtaattattgagaaaaaataagttttgtttttttagttattgtgagtgttgtttttagaaaagtaagaagtttttttttttttaaaattggattttttgtttttattataatatagaggaggttttgttttagggagatttttattttgtttaataattgataattgtaaaatatttggttatgttttatgttgttttaatatattattagttttattttggttagaaaaataaaaatttaatggtggtggtagttgtttgataatgggtttaaggtatattggagattttgttttttttattgtgggtggggttggggatggtgggtttggtgggggaggggaggagttgggttggggtttgggaaggtagagagtgagttttattagtaagatttgattgtggtttgggagagaatttaattatttggtttattttagaatgaaatgaatagggaattgggttaagtagtttaaagtttattagagttagaatatttgaatgtttttaggggataagtaggttaaaaaaaggaggggggtggggagaaaggttttaggaaagggtaggttttatgggggataaggaggggaaagttggattgaaggtttttaaatttatatttttgaaaagtagtgtttttaagtgttggttaaagtaaatattggtgtaaggtgtaggggggtatgtatatgtggatttttaagtttgtaattttttttagttaatgtgatttattgtatatgtaaaatttgttattggtttatttttgtttattatttatttatattatgtttatttatgtatttgttttatattgtttgggtttgttgtatagttgtgtgaggtgaaggtagagattagagtttttttttttttgttttgttttagtttttggattggtttaggagatggtatagtttgggtgtttgtaggtgtgtggtattggtgggatagtaggttttggttagttgagttgtgtattgttttgtattagtagttagggttaggggtagttgtatgggtatgttttgttgagtttttttattaattgtattttttttgaagtttgtttgttggagttgttgattttgttgtgtatgttgatgtaaagtgtttaggggatttaaggtagggagtgggaatttgattgttatatgtagggatgtaaatttatttgtgtgtgtgtttttgtttgaattttatttttggtgtttgtttgtggggatttattgagtgtggtagtttggtgggattaggtttaaagttgattatttgtttgggggtgtttatggtgtggtggttagggtggtgagttagttaaggaggattgaatgtgtgaatggttggtgtttttggttgttgtggtgagagtttgtagttggttttgaatttttgttttgtttttgtgttgagttggtgttttattggtttgtgttgttgtaggttttgtgttaattggtttgtgtgaaggagtttatatttttattggttgtgtttttgagttgagttgaagtagttgtttttttttgtgtttattgttttaatttttatttttgattaatgtaaggagtgtgtgagattgtgttagttagttgagttggtttggttgtgtgtttgtttgaggattgtgggtggtgggaagaggttgtttttgttaatttgtttttgttttttgagtttgtaatttggttggttttagttttttaattttagaggattttagttttttttttttggttgaaagggtagttgttgagtagatttgtagtttttatttatttatttttttattattagtttttagtttgggttgtgatgtatttgttttagaattattagttattaatttattaaatttttttaagtattttttatgggtgttagatattttagtggagagagaggatttttttaaggttggaagtgtaggatgaagaagggttgggggtgggtggatatggttttttgtatttgtatgtgggttttgagtttttgtaggattaaagaatggaggtggttaaggatgtagggaggagtgatagtttgggaagtgtggatgtttgttaggtaagttttttaaagttgttgattttttatttttttttttgggaaatgagtgagttggaaatttgtgatagtttttaggttgtgtttgtgttgataagttgtgagtttagaaatgtgaggagatattaataagaatgtgatatttatagggtgttgtagtttaaattagaagaaggtggtttttagttaggttaggtgtagggttagagttgtttaaatttttttatagaagtgttttttttaaaagaattttagtggagatttgtatggggttttgaaatagaatattttttttttattttgtaagaaagaagtttttttgaagtttggaattttattatttttaaattgtgaattttgtattttttattataatttaatttagttttttttaatgtaaaaatattttttttgtttgagtaaaattgatgtgttaggaatatatatagtttaattgttttgtttagagaaggtttgtaattggataggattttggtttttgtttgttttttttaatgagaatgtgggtggtatggggttgagagtagaggtattgttttggatttgggaattggaggataaagtttttagaaaaaggtaaaatgaataaggtttttgtgttttttagtaattttattaagaaaattgtgatatttaagatagaataaattttagtttagaaatttaggtatgtaagaagtattatatatttattattttatgtaaataatttagttattatatattagtagttgtttttagtagtttatttattggagattaagggagttagtttttattttttttggagttagtttttaatattagggttatatatagttttatgtagtgggttgggagaagggatagtatatttatttggttttttgtttttaaaagatatggttgagttgtttttattgtttaagttgatgtggttgtttgggttgatgagtaatttattatttttgtattttattaggggtataggaatttggggtggggtggtggtggttattgttttatttgttaagatattttttgtagttattttttttgggggttttgtagtttttaagatggtattttagggatataagttatatatatagttagttttaggatttattgatttttgtttgttttttttttgtttttgggtaattttttttttagtttagagaaaatttgttttttttatgttttttttttatattgtgttt

SEQ ID NO: 378 - DNA, 4001 bp, Artificial Sequence
  chemically treated genomic DNA (Homo sapiens)
ttttattttttttatatttgtgttatatattaaaaaattatatattagagaatttaaaagatttgttaaagttgtttagaaagtgatttgatgttaagatggtgtttttttatttgtattatttttatagtttagaagtatattattaatttatgtttttttttataatttggagttatatatggattatgttgttttagttattttgtttaatttgatttttaatattgttattgattttatttttaagtgttttattttaaattatagagtgttaaagatgttggattatttttataatgttatttttaagtttggtgaattaagaaattgttagattattttgtgtaatattataatggtattgttgtaatattatatgttaaatttagaatgtgtaaagattagaagttgatagtaaattattttaggatttataatttgtaaaaatgaagtttggtgttatgaattatgttgtttttaaaagaaatgtaagtttatttttgtaaattttttttttgagaaagtagattattttgatgtgtttttaagtaagatgtatattattttttaagttagttatttttgttatttagtttttattttgagtttttatgtaaatttgggttttatattaaaaagaaatgtatattgtaattgaaaatttgttttggaatataattaattgtttttttaatattttttttatatattattttttttagtaggaaatggtaaggaatatgatttatttaaaattttaatgatttttattgtaaaaaaaataataaatttaagaaaattaaagttgaaattaatatgaaaaattatgaattttttataaatgatgattatttttgttttttttaaataatttaagaatatagtaatgtattatatgtaatttggttgattaatattatgaataattgaattggtattaagttaagtaattatttaaaagatatttttagaaattttaaaagattttttttttaaagtaaaatatttgatttttgattgggaaaaagattgaagagtttaagaaataaaatatttatagagatgaaagggagtttttgtatttttaagggatttatatagtgttagtttatagttttttatatgtgtttatagtttattttttaatgttaataaggagggataaaaaaggttttttattttttagtgtttattttttaattagttattaattaatgttaatgttaagataattaaggttagttgtaaaaaagtttttagaaatttattggaattaattaattagatttgggtaagtgatttattattgtaaatttatgaataatagttagagaaatattattaattttgatttttgtagtattttattaaagaagaaaaatgaaaataatgatatttaagaaattttatgttattatttaagtttgtatgagaatatttatttaaaagataattagaagttatagttatttagttgaataagtgaattattttattatgggttagtttgaagatatagttatatattatttaaaaatggataataaaataatattataatgtttatttgttttttgtttggtttttggaagttatttaaaagaatgtttttttaatgatatatagtaatttttgaggaaaatttttagattttgataggtatttaagtattttagtaggagatattgggtttttggtttttgttagataatattttattttatgattatagttaaattttatagatttttttttaatttaattataagtgttgaaaagagaatgagtaaaagtttgttttagtttttattaaggtatatgtagagattttggaattttttttatatttttaaatattttattttttaattaaagttttttaaaattattttatttatattatttttttttgggttttttgtaggatgtgtttagggtggttgattgtggatttgaagagggattttagttttgttttatgagtttttagtaattgtagttaatgaagtttttatttgtttttatattagtagagtgtttttatttgtatttaagttttgggattaataggaaattttatttaatgattgaagggtatttggtgtaattattatgatgttaatttttattatgatgttaatttgattttattttgttttaatttttaggttatttttgtttggagttatttttaggtgatggtgatgataaggttagtttatgaaaagagagtatgttgttattttgtatgtaattttattgagttatatatataatattttgaaagttgatatttttttataaataagagatatttaattagttaagtatttgatatttatttaaataagagttatagatttttgaaaatagatatagagtatttttaggtttatattattatttaattaggaaatagaaaaataaaatatatatttatttagatttttttaaaattaatttgtatttgaatttaataaagatgtatgagaaaggtatgaggtaattttaagaaggattgaatggtttttaatatatgtgtttggtttttggttttttttttttttttattttatttttgtaaagtttagtttttgtttgaatagaaaatatgtatgttatggtttgttaggtgtgggatatttagttttaaggtttttaatttagtgttattttaaaatttgtatagttttttagattattgtggttttttttttgtatatagagattatgattttttaaaagtttttatttttatttattttgtttagtgttatttttgtaaggaattggtttagatatagattattaaggatttttttaataaagagtttagaagatttatgtgatgtaaaaagtaatttttgtttaatataaagaaatttgttaaagaatgtaaagttgttttgtgatttattttttgtgataaataaatttgtttaggtttttatatttttttagatttttgttgtttttttttagtatgtattttaattatttatttttttttagtgatgtttttttttgggggatgagtgggggagatggaattttgttttgttttttaagttggagtgtagtggtataattttattgtagtttatattttttgggtttaagtattttttttgttttagtttttgagtagttgggattataggtgtgtgttataatgtttggttaatttttgtatttttggtagagataggagttttattatgttggttaggttggtttaatttttgattttaagtgatttatttattttggtttttaaaagtgttgggattataggtatgagttattgtgttgggtttttttagtgatgattgatgttattattatttaagaatttttatatttaaatattaattaattggtagtatatttttaatgtagtagatttattttgaaaatttttttatttaggtattttatttttttttgttttatttttttttttttatttgtgttttttttatatttttttattttttttttatttgaatgattatatagaaataatgtttttaggatgtttttattaaattatttttgtttggtttatgattttatagtggattttatttttattttatatttttatataagaattatgaatattagggaatttttatgaaaatgtttattgtgtttttaaagtttatatattgttttttaatttttttagtgatgtggttatataaataatataaaagttagtgtttttaatatttgatttattttttttatttttttaattattttatttagaagtaatgtttttagttttttatttgtgtttttgtagatattttatgtatatataaataaattatatttaagtttttatttttgttgaaattttttttaaaataataaatagaatataaaaattagaggaatttttgtttttgtgtttagagaatttttgttggtatggtataaattatatttttttgtattttttataataaatatatattatttttataatt

SEQ ID NO: 379 - DNA, 4001 bp, Artificial Sequence
  chemically treated genomic DNA (Homo sapiens)
aattataaaagtaatatatgtttgttgtagaaagtatagagaagtataatttatattatattaatagagattttttaagtataaaggtaggggtttttttaatttttgtattttgtttgttattttaaggagaattttaatagggatggagatttaaatataatttgtttgtatatatatagagtatttgtagaaatataagtaagaaattggaaatattgtttttgagtagaataattgaggaaatggggaagataagttaggtgttaaaggtattgatttttgtattatttatgtagttatattattaaaaaaattaaaaaatagtatgtaaattttaaaaatataataaatatttttataagaattttttaatatttataatttttatatagaaatgtgaaataaaaataaaatttattatgaaattataagttaaataaaaataatttaataagagtattttagaaatattgtttttatgtaattatttagataaaaaagaaataaaaggatgtaaagaaggtataaataaaagagaaagaatagaataaagaagagtgaaatgtttagatggaaagatttttaaaataagtttgttatattgaaaatatattgttagttggttgatatttaaatgtagaaatttttgaataatggtggtattaattattattaggaaggtttggtatggtggtttatgtttgtgattttagtatttttggaagttgaggtgggtggattatttgaggttaggggttaaattagtttggttaatatggtgaaatttttgtttttattaaaaatataaaaattagttaggtattatggtgtatatttgtagttttagttatttggaggttgaggtaggagaagtgtttgaatttgggaggtgtagattgtagtgagattgtgttattgtattttagtttgggagatagagtgagattttgttttttttatttgttttttaaaaaggagtattattaagaaaaggtgaatggttgggatgtatattggaaggaaataatggaaatttgaaaaggtgtaagaatttaaataaatttgtttattatagaaaataaattataaaataattttgtgttttttggtaagtttttttatgttaaataagaattgttttttgtattatatagattttttaaattttttgttgaagaggtttttggtagtttgtatttaagttagttttttatggaagtggtattgagtggagtagataaagataggaatttttgaagggttataatttttgtgtgtaaaaaagaagttatagtagtttgaagagttgtgtaggttttagggtgatattgggttgggaattttggagttaagtgttttatatttggtaagttatgatatatatattttttgtttaggtagaaattgagttttataaaagtgaaatgagaaaaaaaaaaaaattaaaaattaggtatgtatattgagaattatttagttttttttagaattgttttatattttttttatgtatttttattaaatttagatgtaaattaattttagaaaagtttaaataggtgtgtgttttatttttttgttttttaattaaatagtggtataagtttggaaatgttttatatttatttttggaaatttatagtttttgtttaggtaaatattaggtatttagttaattaaatgttttttgtttataggaaagtgttagtttttaggatgttatgtgtatggtttaataaaattatgtataaagtgatagtgtattttttttttatgggttgattttgttgttattattatttgaaaatggttttaaataaaaatgatttaagggttgaaataagataagattaaattgatgttatggtaaaaattgatgttatggtaattatattaagtattttttaattattggatggaattttttgttgattttagggtttagatgtaggtggaaatattttgttggtataaaagtaggtgaggattttattaattgtagttattgagaatttataagatgaagttaaaatttttttttggatttatagttaattgttttgaatatattttgtaaaaagtttagagaaaggtaatatgaatgaaataattttgggggattttaattgaggagtaaaatatttgagaatatgaggaagattttaaagtttttgtatatattttaataagaattgagataggtttttatttattttttttttagtatttatgattgaattagaaggaagtttgtaaaatttggttgtgattatagggtaagatgttatttaatagaagttagaaatttaatgttttttgttgagatgtttgagtgtttgttaggatttaaaaattttttttaagaattattgtatgttattggaaagatgtttttttgagtggtttttaggagttagatagagggtaagtagatattatgatattgttttattatttatttttaagtgatgtatagttatatttttaagttggtttatgataaagtggtttatttgtttagttgaatgattatagtttttgattattttttgaatagatgtttttatgtagatttgaatagtagtatggaattttttgaatgttgttgtttttattttttttttttaataaaatgttataaaaattaaagttggtagtatttttttagttattatttatgaatttgtaatgataagttatttgtttaagtttaattgattagttttaatgagtttttggaaatttttttgtagttaattttggttattttagtattagtattaattggtggttgattgggaaatagatattagaaaataaaagattttttttgtttttttttattagtgttgaagaataggttatgggtatgtgtgaagaattatgggttgatattatatgggttttttaggaatgtagaagtttttttttatttttgtagatattttgttttttaagttttttaattttttttttagttaaaagttagatattttgttttagaaaaggaattttttaaagtttttgaaaatattttttaaataattatttgatttaatattaatttaattatttataatattggttaattaaattgtatgtaatatattgttatatttttgaattatttaaaaaagataagagtggttattatttataaaaggtttgtggttttttatgttaattttaattttggtttttttaagtttattattttttttgtagtaagagttattgaaattttaagtgagttatattttttattattttttgttgaaaagggtagtgtgtgagaaaaatgttagaaaagtaattaattatgttttagagtagatttttagttgtagtgtatatttttttttaatgtgagatttaaatttatatgaaaatttaaagtaagagttgggtaatagaaatggttaatttagaaggtaatgtatgttttgtttaaaagtatattaaagtaatttatttttttaaagagaaaatttataggagtgaatttatattttttttgagaatagtatggtttatagtattaaattttatttttataggttgtgaattttagagtagtttgttattaatttttgatttttgtatattttggatttggtatataatgttatagtagtgttattgtaatgttgtataaagtagtttagtaattttttggtttattaggtttagagataatattgtagaaatgatttagtatttttaatattttgtggtttaaggtggggtatttaggggtagaattaataataatgttagaaattaaattagataagataattgaaatagtatgatttatgtgtgattttaagttataaaggaggatatggattaatggtatatttttaggttataggggtagtataagtggaaggatattattttagtattagattattttttgagtaattttggtaaattttttaaattttttaatgtgtagttttttaatatatgatataggtgtaaagaaaataaag

SEQ ID NO: 380 - DNA, 4418 bp, Artificial Sequence
  chemically treated genomic DNA (Homo sapiens)
agattttatggaaggggatagggagttgggttttttataggtatttgttgagaaaggtaggaaggtttttggttttataaagtggttttgggtatttaggaagtgtttggggtggaagtggaagggttttttttagatggttttattttttagtattgatgataggttggtgatgagtgttgttttttgggtaggagatgtagggtgagagtggggattggattttaggatgttgggatttttgttattaaatatatgggggatatatattgtttggtatatagttggattttgttaattagttttgtgtttgagaagttttatagtattttttttgattttatagtagggtgtagttatattttttagaggtatttatattgttttttttttttgtaggtgttgggttttttaatattttggtaggttttgatttgttttttttattagattggggttttggatggataggttagttttgtttatattttggattttttatttaagtggggatagttagtgtggtggtattgaggattaggtggttagggtttttagagtgggtttatttggtagtagttatgttggggttattattaggggttggtgttgagttggggtgaggagggtgttaggtttattttagggatgtggaagttttgtattttgatgttatgggatgttatatgggttatatttagggggatgatgtttttaaagtgttgtattttgtgaattatggtagtggtgtagggtatgtgagtttggttatttatttttggttgttgtatttgttttattatgttgttgattttttgttggatatggattggatagatatgtgtttttataatgggttagtatttaggggatattttttttttttttgtgttggaggaagttaggtttataggagtttggttatgtttgtgttggaagttttgggtgttttagttaagtttaggggtttttagttgtatttttttttttttagtttttgttttgggttttagttgggtttatgttgtatatttaggtgtaggattatgagtaggaggttttaggttagtgtggttgaggtggttattattttggtaaggaataggttatttattattatgtgtaggtttttattattgaagttgtttttagggttttttttggtttgagtagggttgagaggatatttaggggatagaatggggtagtttttaaatgatttttaattttgtatttgttagtttagatgtggtttgttgggtgatgtattggtttaattttttgtttagtttttttttattttttttgggatgtttaatttattatttttgttttttattgtggtagttatttttattttttttttttttgttaggaaggttttagttaggttttggggtggttgggttgggttttaggttattttgtgtttagttagtagtttatttagttgggttaggaaagttttttggaagtgtaggattttgttagttagtgttgggatgtgtgggaggatggggatagtatttagtatttatattagatagaatggggttttaattttttttgtgttttgtgtttatttggattagttttaggttttagttatttttaggaagatttagggtttgtttgtttttattattgattttattaagtttttttttaagtgttagtttttattttttttttttttgtttagaggagaaatttaaaattgaaatttttaatgtggatgggggtatagagtttttggttttttttggtgttttttgatttgggtatattttttttatgattatgtttgagatgttttttttttttttaggttttttttatagtggggttttttggaatgtttttttttaaatttatttatgtaaattttgttttttggaggttttagtttagttttggtattttttaggagtttgttttgtagagattttttggttttttgttttgtattttgtgtaggaagtttgattttttttttagttttttttgagttaggtttagtagtttgaggaagtgagggttgttgtatttgaagtggtgtttgtaggtgagggaggtgattatgttgtttatggttttgtttaagaggttgttggggtgaaaggggtgttttgggggtgggagatgtgggtaaggggttgttttttttgttttttgtttttttagtttttgttttgtgtttttttgtttattatttattggtttggttggtgaaggtggtataaaggtaggtggtttttttggttatttattgttttagtgattttttgtttaggtttaagttgtgtaaggtggatatggagaagtgtttttgtttgtgttatgtgggtttatagtgtgataggattatttttgggggtgggatgggtatgtgggtgttgttatgaaggttttggttttattttttgttatttattttaattttggtgttttataaggttttttgtagtttttagtttggtttagttgggtatagggtttattttttgtttatttatattgtttttttgtttggggtggggtttggttttattttgtttttgtttattttgattatttttttatttaaggaagattttgtttgttttgtttatattgagtttgtagtataggtgtggtttttgttattgttattttgatgtattagttttgtttattgggtttttggtgggtttgggtagtagttttgtttttttttagtttatagatttgtattttttttgtgtaggtggttttttggtttattgtttttagtttatttgttggtttttatttttgttttatgtttaggattttatgttttgttggtgttgtttgggttatggttattgtttatttggggtttatggaaatgtggtttttgttttttattgttgtttgttttgggaatgtggtttgaagtttaggatttggtagatgggtgtaggtgggtggttggttgtgtttttgttgtgggttattattgttttgtgtatggttgttagtttattgagtatgattattggtgtttaggttagttgtaggttgaatatgtttttgaagtggtgttgtaattgtagagggagggttagggttttttgttaagttaggattattttagattataggttttagttttatttgaattttggatgatttttggggttattaggagtgagtaggtggaaggaggagatttagttttttgattttggggtgggggtgggggttatattttttgtgatggaggaatttagtttggatgtgttatttaggtatgattttgtaagagttattaaaattgttgagaggttttagttagtattttatttttagatgatggtttatgttggtgagtagtgaggtttgaggatttatagtgtaaaaggtttgaattgggttattgtattttttttatttttgattttgtgatttaaatggtatttaggattaatttattttttatttttaaggtttttttttttggtgttagtagaagggattttgtattttataatatatgttgtttaatgggtttgtatgtttattgttaagtttagttttatttttaggtttttgttttatttttttttggtttttggaaaatttagttttttatgttatgtataaatgtttttttttaggatgttttttaaatttgttttttttttttagtttggtttttgatttagtttgtggtttaatttattatttatgtttgttggtggtggggtatttttaggatttttgttgttttttaggatttttttttttatttggttgaagtagtatggtgtgttttggaagtttatatgtagtaaggttgtttagtttgggtagtggtaggggatttggtgggtagtgtgtagtttagtgttggtgttggtgtattaggtttattaggagtaggaagatggttattattatggttaggggtattagtgtttttagttttatggttgttttattattaattgggtttttttggatatatttggtatttttattttattaggtatagaggattaggtaggatatttttggtatattgagtgtgtgattttttttttataaagggagttgatgatggtttttgttttttgttgtgagtgaatttgttgtgttgattgtgttgttagtggtagagttaggttagggtaggtatgggttgttttagaggtttttgttgttgttttttgttttaggtttttatttagggtagggtggtagaaaggtttggttggagaagttattttttttttttattttaagttttttaagtttatataggtttttgggataattagggttttagtggatttggttatttattttttagttaggtttatatattttaatgtagttataattttttttttagaatatgattttgttttttttttatttttatttgtttattt

SEQ ID NO: 381 - DNA, 4418 bp, Artificial Sequence
  chemically treated genomic DNA (Homo sapiens)
gagtgggtaggtgggggtagggaaagggtaaggttatgttttggaggaggggttgtgattatattagggtgtatgagtttagttgggaggtggatggttgggtttattgagattttggttattttagaagtttgtgtgggtttggggagtttggagtggggagagggggtgatttttttgattaggtttttttattattttattttgggtaagggtttggagtaggaagtagtggtaaggatttttggagtagtttatatttgttttggtttgattttgttattggtagtatagttaatatagtaggtttatttatagtagagggtgaaggttattattagttttttttataagggaagggttatgtgtttggtgtgttgagagtgttttgtttggttttttgtgtttggtggggtgggggtgttaggtgtgtttagaggagtttagttggtagtgaggtagttatggggttagaagtattggtgtttttggttatgatagtggttatttttttgtttttggtggatttgatgtattggtattaatgttgggttgtatgttatttgttaggttttttgttattgtttgggttgggtaattttgttgtatgtggatttttagaatatattatattgttttgattaggtgagggaggaggttttggagggtggtagaggttttgaggatgttttattattagtaaatatgggtggtgggttaaattataggttggattagaagttaggttgagaaggggaagtaggtttgggggatgttttggggaaggatatttatatatggtatgaaggattggattttttaaaggttaaggaagagtagggtaagggtttggaggtggagttggatttggtagtgggtatgtaagtttattgggtaatatatgttatggagtataaagttttttttgttgatattagaaggaaaggttttgggaatggaagatgagttagttttgagtgttgtttaaattatgaaattgaggatgaagggggtgtagtgatttggtttaaattttttgtattgtgggtttttgggttttattgtttattggtatggattattatttgggaatgggatgttaattggggttttttggtaattttggtgatttttgtaaggttatatttgggtgatgtatttaaattgagtttttttattatagaaggtgtgatttttatttttgttttaggattaggaggttgggttttttttttttatttgtttatttttggtagttttgggggttgtttaaggtttaaataggattaggatttgtagtttggggtgattttggtttgataagaggttttgattttttttttgtagttgtggtgttgttttggggatgtgtttagtttgtagttggtttggatgttggtggttgtgtttaatgggttggtggttgtgtgtgaggtgatggtgatttgtggtgaggatatggttgattgtttgtttgtgtttatttattaggttttgggttttgggttgtgtttttaaggtaagtggtggtgggggatagagattgtgtttttgtgggttttgggtggatagtgattgtagtttaagtagtgttgatagggtgtggggttttggatgtgaaatagagataaaggttagtgagtgggttgaggatagtgggttaggaaattatttgtatgggggaggtgtgagtttgtgggttgggagggggtggggttattgtttagatttgttagaagtttggtgggtgaggttgatgtgttgaagtggtggtggtggggattgtgtttatgttgtgggtttagtgtgggtgggatgggtgggattttttttgagtggaaaggtggttagggtgggtagagatgaggtggggttaaattttgttttaggtaggggagtaatgtgggtgagtaaagagtgggttttgtgtttagttggattgggttagggattgtgggagattttgtggagtgttagggttggagtgggtggtggagggtggggttaaggtttttatggtaatgtttatgtgtttgttttgtttttaggggtgattttgttgtgttatgggtttgtgtggtgtgagtagaggtgtttttttgtgtttattttgtgtaatttgggtttgggtaagaagttgttggagtagtgggtgattgaggaggttgtttgtttttgtgttgtttttgttgattaagttggtgggtgatgggtagaagggtataaagtgggaattgggaaggtgggggatggagaaggtaattttttatttgtattttttatttttaggatgttttttttgttttaatggttttttggataaagttgtgagtaatgtgattgttttttttatttgtgggtgttgttttgagtatgatgatttttgtttttttaggttgttggatttagtttaggagggattgaaggaggagttgggttttttgtgtgaggtgtggagtgagagattgaggagtttttgtagggtgagtttttgagaggtgttggggttggattggggtttttgaagggtaggatttgtatagatgggtttgggaaaggatattttaggagattttattgtaagaagggtttggaggaggaggggatattttagatatggttgtgggagaggtgtgtttgggttagggggtattaggagaggttaaggattttgtatttttgtttatgttggagattttgattttaggttttttttttgggtaaggagagagagggtggaggttggtatttggggagggatttggtgaggttagtggtaaggataggtaggttttgggtttttttggagatggttggggtttgagattggtttaggtgaatgtagagtataggagggattgagattttgttttgtttggtgtaggtgttgaatgttgtttttgtttttttgtatattttagtgttggttggtaaggttttatgtttttaaaaggtttttttgatttagttggatgagttgttaattgagtataggatgatttgggatttagtttagttattttgagatttgattgaggtttttttggtaaagaaggagaaggtgagagtggttgttatggtggggggtaagggtggtgggttgaatgttttaggaggaatgaggggaggttgggtaaaaggttggattagtgtattatttggtgagttgtatttgggttgataggtgtagaattggaggttatttgggggttattttgttttattttttgagtatttttttggttttgtttaggttaaggggagttttgagagtagttttaatgatgagaatttgtgtatagtggtgggtaatttgttttttgttgggatggtgattattttgattatgttggtttggggttttttgtttatgattttatatttggatgtgtagtgtgagtttagttggggtttaaggtagggattgagggaggaagggtatagttgggggtttttgggtttagttgggatatttggggtttttagtataggtgtggttaggtttttgtaagtttaattttttttaatataggaggaaggagagtgttttttgggtgttgatttattgtggggatgtatgtttgtttagtttgtgtttaataggagattgatgatgtgatagggtaggtgtggtgattagagatgggtgattaggtttatatgttttgtattattgttgtgatttatgaggtgtagtgttttggggatattatttttttgagtgtgatttatatgatattttgtgatattgaagtatagggtttttgtatttttaaggtaggtttggtgttttttttattttagtttagtattagtttttggtgatagttttagtatggttattgttaggtgggtttattttaggaattttggttatttagtttttaatgttattatattgattgtttttgtttggatggggggtttagagtataggtagggttggtttgtttatttagagttttagtttagtggggaagataaattaggatttgttagaatgttggaggatttagtgtttgtagggagagggggtagtgtgggtgtttttgagaggtgtgattgtgttttgttgtggggttggagagggtattgtggagttttttgggtgtaggattagttgatagagtttagttgtgtgttaggtagtgtgtgttttttgtgtgtttggtggtaggggttttagtattttagagtttagtttttatttttattttgtattttttgtttagggaatgatatttattattaatttgttattggtgttgaaggatgaggttgtttggaagaagtttttttgtttttattttgaatattttttggatgtttagggttattttgtgaagttggaggtttttttgttttttttagtaggtgtttgtggggagtttggttttttgtttttttttgtggagttt

SEQ ID NO: 382 - DNA, 4398 bp, Artificial Sequence
  chemically treated genomic DNA (Homo sapiens)
ttgttttaaaaaatattttaaaaaaataaataaaagaatatttattattattaatagaataaattgtgatatatttataaaatgaaattttatagaagaataagaggataaaaggaattaattattgatatgtataatatggattaattttaaaaatattttttgagtagttagatatggtggtttatatttgtaattttaatatttttagaggtaaaagtaggatgattatttgagtttaggagtgagtttatagtgaattgtgattgtgttattgtattttagtttgggttagagttggttttatttatatgaagtttaaaaaaaggtaaaattatttatttatgatgataaaagttagaataagaaggtggtagggattgatagagggtataagggaattttttgggatgatgtaatattttgtatattgagggaggtgtggttatatagtatatgggtttgtttaaatttattaaattgtaatatttaatatttatatattggagaatatattttatagaagtagatgatagaaatggttatttttttatataatttgtaaaagaagtgtaatattgttgattattttttttttataagttattattaatttggttttagtgagattatattggtttttttttttatttggattattttttaaatatattttttttttttattttttttttatgtttttatattttaattataatttaattttttttttttataaattattatttatgggttgaagatatttaagtttattaaattttatatttaaaaatttagttgttattaagtatgatatattataaatttaatatttataaattttaaattttttttttttgtttttattgtaatttttttattaatttttgaaaaaaaaaaaaaaaatttgttttttttatttgagattagaattatttgtttttgtttttagagatagggttttattatgttgttttaggttgattttaaatttttgggtttaagtgatttttggttttggttttttaaagtgttgtgatttataggtgtgagttatggtattagatttgaaattttttttaaatatttgttttttgggtaagttgtagtgttttatagaaaaaggaaatgaagtaatagtaatggagtattttttatattttatttgggttttttattattgtagtttaattgtgtattttattgatattttttatatttttttagaggattaggagggaatatattattttagatagtttttggtgaatagttaatatttatttagaattaattatttgtttaaattgttagttatttgatatattttatttaatgtgtattaatgttgttttggatgaaattgagtttataataaattaaataatttggttaaggttatataattaaagtggaaaatgttatgatttgaaaaggtatgtttggggttttaaaattttttatgtttatttttaatatatgttggagagttaaattttaattggtagaatttgtgtgaaatggaatattttttagataatttaaataatgagtatttgttaaatattttataattgggaaagtgtaattttgttgtatgtaatttttttttttggatgtgttaagtaatttgttaaattttttaatttagattatagttttttaattttttgtattatggtttttttaaatgtttttatagttttgtgttttttaattttgagtttaagtgaggttgtttatggggttttggtagatgataaatgataaggaggttgaaagttagatgtttttgaattgagggagaaggttggatttttgatttgggttatattggggatttttataaattattttttttagataagtgattttgggggttattttgatttttgtagtgagttagattaaatttttatgttaggttagtttttgttaggtgagtaggtatataaaaagaagttttagtgattattgtatgttggtgtggagaggttttgggaggtgtaaggagaatagagatgaatttgattgtgggtagaagttttttttggttttaatgttgtgattgtttgttgttgaggttagggttgttattttttatgtttgagttggttaggtgttatttgtatttgtgggttataggtttttgaagtttatgtttttgttaatttttgtgtgaagttattaaatttgtagtatatgatgtttagagtttggttttttgtatttgttgttaatgtgattgttttagagaaggattttgtttttttggttgtggttttgagatttagtgtaaggatttggtgttgggattagggttgtttgaagattgtttaatttaaaatttgtatatttaagttgtattggggaattaaaagttagggtttttaggattatgaaaggtaaaattagttttaagagagtatgtaaagttgttgtggtggagtttgtaggaaatatgaagtttttttttttttttatttagatttgggtagtgttatgataatttaagaaatgtgtaagtgttttatggattaagtttggtggattaagtttggtagtgttggagttaggtggagtatgttttaggaggggtgggttttaggtggggtttgggggggagagggtggtgattggtgggtgtggtttgggtaggggtggggttatattgaagttggttgggaattttattatttgagagagtttgtgttgtggagttattgtttggttgttgggttgaaggtgttttttgttttattgaattttaattgattgtagttttatttatttttttttgatttagagtattttttatttagaagttattatttgttgttgtttagtttgtttaggagtatagatttgttggttaagttttttttggtaatttgggagttgaagtaaataagaaaatttggaagtatttgttgaaggttgtttagtatttagggttgttgggagatttgttttaataatataaaagtagttttttgggttttgtgtagaggaaatatatatgtagagtgatttaaagtttaggtattaggatgtaaatgttatatggttttttagaattggtttttatttttatttgagttttaaggttattgattatttattttttttttggtttttgttttttgtgataaatgaggtagggggagggtgattagaaatatttgtaaaatttggattttgagtttgaaagatttggaattattatttttagttttggtagtatttgttttagtttaatttaaatatgtttgttaagtttgtgttgtgtgtaaggtattgtgtaaaaggagtatattagttttttattttttagggatggatttaggttttttttagttttattatttaattataggtttatataagtatattttagatgtatttatgaaattatgttgtaaattgatggatgatattaatttatatatagtattgttttaaatttatttaatttttataataattttataaggtaaatgttattattatttttattttagaatataggaaaatgatgtttggagaagttaagtaatttgtttaggttagggataagtggtagagttaggtatttggtttaagattttttattgttaagtattatgttataaataaatagatatgaagttattttgaaaagaggaggattaaggttgagtattttagggtgagggtgtatattagtattttggttgtaggtttatgtttaagagttttaagtatttagtattgttaatatgttgtaaaggttttagtgaatttatgtaagttagtttaaagttgttatttttataaagagatattgtgatataatggaaagaatatgtaatttgggtttatgtttatatttttttaaggataagtggtttgggattagtgatttttttttttttttttttttttttaaattttttttgaaatagggttttattttgttttaggttggagtatagtggtgtgattttggtttattgtagttttgattttttaggttgaggtgatttttttattttagttttttgggtagttggaattatagatgtgtgttattatgtttggttaattttttgtatttttagtagagatggggttttattatgttttttaggttagttttaaatttttgggtttaagtgatttgttaaatttaagatttttaaaatgttgggattataggtatgagttattgtgttaggtttattttatgttttgatattgaatagatttaggaagatttttttatgataaaaagtttgattattttaaaagaaaatgatttattgatattagtttttttgagttttaggtgttagtaaatattgagtgaaagaaaaagttttttatagagtttagattgaaaagagaaattaaatgatt

SEQ ID NO: 383 - DNA, 4398 bp, Artificial Sequence
  chemically treated genomic DNA (Homo sapiens)
aattatttaatttttttttttaatttaaattttatgaaaggtttttttttttatttaatatttgttagtgtttgggatttaagaaggttaatgttaatggattatttttttttgaggtagttgaattttttgttgtagaaaaatttttttgaatttatttagtattaaaatatggggtgggtttggtatggtggtttatgtttgtaattttagtattttgggagttttgagtttggtagattatttgagtttaggagtttgagattagtttgggaaatatggtgaaattttatttttattaaaaatataaaaaattagttaggtgtggtggtgtgtatttgtggttttagttatttgggagattgaggtaggagaattattttagtttgggaagttaaggttgtaatgagttgagattatattattgtattttagtttgggatagagtgagattttgttttaaaaagaatttaaaaaaaaaaaaaaaaaaaaggaaattattagttttaaattatttatttttggagaaatatggatataaatttaaattgtatgttttttttattatattatagtgtttttttgtaaaagtggtaattttgggttggtttatatgaatttgttgaaatttttataatatattggtggtgttgaatatttggggtttttgaatgtaagtttgtaattaggatgttggtgtatatttttattttggaatgtttagttttgatttttttttttttagaatggttttatatttatttatttgtaatatagtgtttaatagtaggaagttttgagttaaatgtttagttttgttatttatttttgatttgagtaagttatttagtttttttaggtgttatttttttgtattttaaaatggagatgataatagtatttattttataggattgttgtgaagattaaatgagtttagggtaatgttatatataggttagtattatttattaatttgtaatatgattttataagtgtatttagaatatgtttgtgtaaatttatggttagatgatgaagttaagaaaagtttgagtttatttttggagagtaagaaattagtatattttttttatatagtattttgtatatagtataggtttaatagatatatttaaattgaattgaagtgaatattattagaattgaaagtggtagttttagattttttaggtttaaggtttagattttataagtgtttttgattattttttttttattttatttattgtaaagagtagaggttaggaaaaggatgaataattaatgattttaaaatttaggtgagaataaaaattagttttgagaaattgtgtgatatttatattttggtatttgagttttagattattttgtatgtgtattttttttgtataaagtttaggaggttatttttatattattggggtaaattttttaatagttttgggtattaaatagtttttagtaggtgtttttaaatttttttatttgttttaatttttaggttgttaggggaagtttggttgataagtttatatttttgggtagattgagtaatagtaggtggtggtttttggataagaggtgttttaggttggaaggaaataaatgagattatgattagttaaagtttggtaaagtaagagatgtttttaatttgatgattagatggtggttttgtagtatagatttttttggatggtggaatttttaattggttttgatgtagttttgtttttatttagattatgtttattaattattgtttttttttttttaggttttgtttggagtttgttttttttaaagtatgttttatttgattttgatattgttgggtttagtttgttgggtttagtttgtggagtgtttgtgtattttttgagttgttgtggtattgtttaaatttgaatgggggaaagagggaattttatattttttatagattttgttatagtgattttgtgtgtttttttagagttggttttgttttttgtggttttgagaattttggtttttggttttttaatgtggtttaagtgtgtaggttttaagttaggtgatttttgggtagttttagttttagtattgggtttttgtgttgagttttgggattatagttggggaggtggggtttttttttggggtggttgtgttggtagtggatgtgggaagttggattttgggtgttatgtattataagtttagtggttttatgtagaagttggtaggagtatgggttttggaggtttatagtttgtaggtatgagtggtgtttggttagtttggatatgagaagtggtggttttagttttggtgataggtagttgtggtgttggagttaggggaggtttttgtttgtggttgagtttgtttttgttttttttgtattttttggggtttttttatattagtgtatggtggttattgaggtttttttttgtgtatttgtttatttggtgggggttggtttggtgtggaagtttggtttggtttattgtaggggttaaggtgatttttggggttatttgtttaaaagggatggtttgtgggggtttttagtgtgatttgagttagaggtttggtttttttttttaatttgaagatatttggtttttggtttttttgttgtttgttatttgttagagttttataggtagttttatttgagtttgagattagagagtgtggggttataaaggtgtttagagaaattatggtgtagggggttggggggttatgatttgggttgggaaatttaataggttatttaatatgtttagggagggaagttgtatgtagtgaggttatatttttttgattgtaaaatatttgatagatgtttgttgtttgggttgtttgaaaagtattttattttatgtagattttattaattggagtttgattttttagtatgtgttgggggtaaatatgagggattttagagttttagatgtgtttttttaaattatggtgttttttgttttaattgtgtgattttggttaagttatttaatttattgtgagtttagttttatttagggtggtgttagtatatattaaatgaagtgtgttaagtgattagtagtttgggtaggtggttggttttggataagtgttaattgtttattagaagttgtttgagatagtatatttttttttaattttttagagaagtgtgggaagtgttggtgagatatgtagttagattgtagtagtgaggggtttagatgaggtgtaaaggatattttattattgttgttttattttttttttttgtgggatattgtagtttgtttaagaggtagatgtttaagaaagattttaggtttggtattgtggtttatgtttgtaaattatagtattttggaaggttgaggttgagggttgtttgagtttaggagtttgagattagtttggggtaatatagtgagattttgtttttaaaaataaaaatagatgattttaattttagataagaagggtaagtttttttttttttttttgggggttagtgggggagttgtggtgggaatgggaaggaagagtttagggtttataaatgttgagtttgtgatatgttatgtttggtagtagttagatttttgaatatggagtttaataaatttgggtgtttttagtttataggtggtaatttgtagggaagaaaggttggattatagttagagtatagaaatatgagggaagggtggagaaggagaatgtgtttaaagaatagtttggatgagaagggaaattagtgtggttttattgaaattgaattggtaatgatttgtaaggaaggaatagttagtagtgttgtattttttttatagattatgtgagaaaatggttatttttattatttgtttttatgaaatgtattttttagtgtatggatattaaatgttatagtttgatgagtttggataaatttatgtattgtataattatattttttttaatatgtaagatgttatattattttaggaagtttttttgtattttttgttaatttttgttatttttttattttgatttttattattataaatagatagttttgtttttttttgaattttatgtaaatggaattagttttgatttaggttggagtgtaatggtatagttatagtttattgtagatttatttttgagtttaagtaattgttttgtttttgtttttgaaaatgttggaattatagatgtgagttgttgtgtttggttgtttaaaaaatatttttgaggttagtttgtgttgtatgtattagtagttaattttttttatttttttatttttttgtgggattttattttataaatatattatagtttattttgttggtggtagtagatgtttttttatttatttttttaaaatattttttgagatag

SEQ ID NO: 384 - DNA, 4471 bp, Artificial Sequence
  chemically treated genomic DNA (Homo sapiens)
aatttatagaggtatatttatagaggttaaattttattgtatgtaaattatattgttgtagtttaatttttttaaagtgttattgtatataaaataatgtgttagatattgaattatgaaatttaatgtttaagtatataatttttaaggtttttagatgtattattaaaaatttattattaaatattttgagtttagtttttagtattttatattttatttatatttatattttataaaatgatttaaagtattatttaaaattattatatgaattttgaattattatgtgtttaatatatatttatagaaaattttttttttatttttaaaagtgaatatattaatatttattaaatgttaattatatggttatgagttgaatttattattaaattttattttttttgaattataaatatattaagaaatgtaaattgtgattagatttatttatattttttagaatattatgaaatgtgttttaaatatgttaattgattttagaaatttttatgttttgagtaagatttaagtgttaataagtatttgatggtttttaaaataagaatgttttagaaatttatttaaaaaaatgtttgaatgtaaaatgtaattttatggtgtatattttaatgtttgttgatgaatagatttttatagttttttttttttagaatttatattaaaatatattttttttagaaaaaataggagttaaagatgttaattatgttttttttatagttatgttatatttgttttataatatttttagaaaagtttttttttttatatgtttattttttaaattataaatatgtttttttttattagatattgagttatgaaatttagagtaaaagtaaaattttttaatggaatgtttatgtaaatattagaaatataataaaataaggtaaagtttgttttttaaaatgttgtttattatattaaaatataattttgttttttaaatagtgagtaaaattaaattaattttatttttttaaatagaagtttatttaaagtttttttataaaaatgatatttatttgatttaatattgtttttttaataagaataatatgtagggtgttagagggtagttgttggatttttttttagtaaataaaggagattagttagagtttagtttggtttgtttaggaaaggaggaatgtagtttgttgatatggttaaggaatgttaattaatatattttaaaatttttattattttgtttgagatgtgtatatttttttaggtttttaaagtttaattagaaagtgtatttaattttattgttattttatttatagtggggaagtttattgaggaaaattatagggaaataaaatgttttttagttatttatattagtataattaatttagagtttatggtataaattaaataagttaatttgttagtgttttgaatgaagatatttaattaaagtatgtattttttaattttttagtagtttttaggatagttggttttggtgattgttttttggttttttattgtttttaatatgattggttttttattgtaggattttaaataaaatgagataattaaattatattttgagtgaaggggtgtttattttgtagataaatatattggttttgttttttttaaaatgtggatatgtgttttttttgtattagggggggttttttggtgtgtgttttgttgttatttgttgaggaaagtgagtgtattttttgtagtttaggttttgggtgttagttttgttttgtagttttagagtttgttgtagtttgggtggtttttttttggtttagtgtttgttgtttgttttttgttttgtaagttttaagaggtagttattttttgtagtttttgtgtttgtaattgttttttggtgggggagtgggtgtttaaaaagttagtagttggagaaattgaaaagattataagtgatttaatgataagtttttttttttttttaaagattgagaggagggtagaggggagtagtgtttgagtttatgtgattgagttagggagtttgatggttttaggaatgtttgatgttgtgtgtgatttttaagtgggagtatttttgaattgatttttggtttatttataaggatagtggtgtatagatggtgttttttgtagttttagttttagatttaagaggtttggagtagggtttgagaatatgtatttttaattaggttttgggggatgttgatattgatatagttagtttggggattatattttgaggattatgtttttagtttttgatttatataagtgttatttagaatagatgtttgattttaaggagttagtggtgaaattagagaggttttgggtttgttaaatttttagtagtaaatgtaattttgggttttggagtggtaaagttgtggattagaggtggagggagtgggtttttagtttttaagaggttattgggaaggttttttgtgttagattaaagattttaggtatttttttgaatttatttgaagtggtattggggagatttgtgtttttggttatggtgtttttttttgttggaggtatttgtttatttttttttttgggtgaaggttttttgtgttttttggtggtagttttagtttttttagtttaatggggtgttttttttatttattttagtaggagttttagggtgtgagattaggattatagttttaattggttttaaggtagttgttgttgatgaaaatgaaaaggaaagtagtatgtgatttataggttattgtgagaattttttagtgttatatttgtgtttaattaattattaaattatttatttaggtggtataagggatatggtttttgagggttgtgatttagatttttaatagaggaagatgagggggggtatttggagggaaagttttatagtattagttttagttgtttggtgtttagttaaaatagagagatgtaagtgtgttttgggttgataaagatgaggtttataggtaatgaagataggttttaaagatggagaagtatttgttttattagttaaataatagttgtgaaaagtttttattgttttattttaagtttaatttttattaaagttgagagttttggttttttttaggttgaaaggtagagtttttttgtttttgaggtagagaagttagtttggatgggaagagtgtgttgttggtaaataattgtagtagataatatgttaattttagtttttttgttttttgttttggggttttttaaagtatttagtttttatatgttttttttttttgttattttatggagaaaatgttaaatgatggtttaaaaaaattagttttatggttaggtatggtggtttatatttataattttagtattttgggaggttgaggtaggtggattatgaggttaggagtttgagattagtttgattaatatggtgaaattttgtttttattaaaaatataaaaattggttggatgtggtggtatatgttagtaattttagttatttaggaggttgaggtaggagaattgtttgaatatgggaggtggaggttgtagtgagttaagattgtgttattgtattttagtttgggtgatagagtgagattttgttttaaaaaaaaaaaaaaaaaaaaaaattagttttatttggtggtatatatttgttaataagatatttttggaaatggaaattgttatgaaggaattttaattataagttaataggtagaaaaagataggtgagggtgaagaaaatgtatttattaatattaatattatatttgatgttgtgttaagtatttgtatagtattttatttaatttttatattagtttagtgagatattgattttatttttttagtgaggaaattgaggtttatagagtttttgttagttatttgaagttatttagtgagaaaggaatttagtaataatagtggttttatagatagttattgtttattggatatttatgttttgtttttttttaataatttttattttatatgtaagtttataaggtaaattttattatttttattttatatttgagaaaatgaatgtttaggaaggttaaataatttttttatggttatatgatttattagtggttaagaaggatttgaatttaggagagaggttaaggatttatttatttttatattatgtttttaattaattagaatgaaaatggtttgattttttgttttatgtagaatattgtagataaatttttgttatttgtgtgttaagtttttgttttgtgtttattgtgatgttttttttagaaggtattttatatataggaatagtatgttttttttttagagtagtttaaatatttatagaagttgtttattatataaggaaattttattgtaggaaataataagtagaaaatgaatgggagtgagtaagtttttttttgatttattttgtttattaagaaagataatgg

SEQ ID NO: 385 - DNA, 4471 bp, Artificial Sequence
  chemically treated genomic DNA (Homo sapiens)
ttattgttttttttgatggatagggtgagttagaaggaaatttatttatttttatttattttttgtttattattttttgtagtgaggtttttttgtataataaatagtttttgtgggtgtttgagttgttttgaaaagagaatatgttgtttttgtgtgtagaatgttttttgaaggaagtattatagtgaatatagagtagaagtttggtatataggtggtagaagtttgtttgtagtgttttgtatagagtagagagttaagttatttttattttgattgattggaggtatggtatggaggtaaatgggtttttggttttttttttggatttaagttttttttagttattgataggttatgtgattatagggaggttgtttaatttttttgaatatttatttttttaagtataaaatgggggtaatagaatttgttttataggtttgtgtataaaataagaattattgagagaaagtggggtataaatgtttaataagtggtagttgtttatgaagttattgttgttattgggttttttttttattaggtggttttaggtagttgatagaagttttgtgagttttaatttttttattggaaaagtggagttaatattttattgagttggtgtgaggattaaatgagatgttgtgtaggtgtttagtatagtgttaggtatgatgttaatattgatagatgtattttttttatttttatttatttttttttgtttgttggtttatggttgaaatttttttatgatggtttttatttttagagatattttgttaataagtatatattattaaatgaagttgatttttttttttttttttttttttgagatagagttttgttttgttgtttaggttggaatgtagtggtgtgattttggtttattgtaatttttgttttttatgtttaagtgatttttttgttttagttttttgagtagttgggattattggtatgtgttattatgtttagttaatttttgtatttttagtagagatgaggttttattatgttggttaggttggttttaaatttttgattttgtgatttatttgttttggttttttaaagtgttgagattataggtgtgagttattatgtttggttatgaagttgatttttttaaattattatttaatattttttttataaggtggtaaggaggaagagtatatggggattgggtattttgagagattttaggataggagatagggaggttgagattggtatgttgtttgttgtagttatttgttagtgatatattttttttgtttaaattaatttttttgttttaaggatagggagattttgttttttaatttgagagaaattaggatttttagttttaatgaaaattggatttagggtggggtagtggagattttttatagttattgtttagttgatgaagtagatgtttttttatttttggagtttgtttttattatttgtggattttatttttattaatttagagtatatttgtgtttttttattttggttaaatattaaatagttgaggttggtattgtaaaattttttttttaaatgtttttttttgtttttttttattagagatttggattataatttttaaaaattatgttttttatgttatttgagtagatggtttgatgattaattaggtatagatgtgatattggggggtttttataatggtttgtgggttatatgttatttttttttttatttttattagtaatagttgttttaaagttagttaagattgtggttttagttttgtattttggggtttttgttggggtgggtgaggggaatattttattaagttgggggaattggggttgttattagggggtgtgaggggtttttgtttgagaagaggggtgggtaggtgtttttagtggagaagggtgttgtggttggaggtataggtttttttggtgttattttaagtgagtttgaggaagtatttgggatttttgatttaatgtgaaaggtttttttagtgattttttgagagttgagaatttattttttttatttttagtttatggttttgttattttagggtttgaggttatgtttgttgttggggatttgataaatttaaagtttttttggttttattattggttttttagaattagatatttgttttgaatgatatttatgtgagttaggggttgaggatgtgatttttgaagtgtggtttttagattggttgtattagtgttggtattttttaggatttggttggaaatgtatatttttaggttttattttagattttttaaatttgagattggggttgtggggagtgttatttgtgtgttattatttttgtgggtggattaggagttggtttgagggtgtttttatttagaggttatgtgtggtgttgggtgtttttgagattgttgggttttttggtttggttatgtgggtttaggtattatttttttttattttttttttggtttttaaaaggaagaaggggtttattgttaagttgtttgtgatttttttagtttttttagttgttggttttttggatatttatttttttgttaggaggtagttgtaagtgtggaggttgtgagaaataattgttttttgaaatttgtagggtgaagagtaggtggtgagtgttgggttggggagggattatttgagttgtgatgggttttggggttgtggggtagggttggtgtttggagtttgagttgtaggaggtgtgtttgttttttttaataggtggtggtggggtgtgtgttgggagattttttttaatgtgggaaaagtatgtgtttgtattttagagaaggtaaggttggtgtgtttatttgtaaggtaagtgtttttttgtttgaggtgtggtttaattgttttattttgtttgaaattttgtggtgagaaattagttgtgttgagaataataaaagattaaaaaatgattattaaaattaattgttttgaaagttattggaaagttggaaaatgtatgttttgattaaatgtttttatttaagatattggtaagttaatttatttagtttgtgttgtgagttttgggttgattgtgttaatatgaataattgaaaaatattttatttttttatggttttttttgatggatttttttattatgggtgaaatgataatggagttgaatatattttttgattgaattttgagggtttgggaagatgtatatgttttaggtaagatgataggggttttaaaatgtattaattggtattttttagttatgttagtaagttgtgtttttttttttttgggtagattaagttaagttttaattggttttttttatttgttgaagaggagtttaataattgttttttaatattttgtgtgttatttttattggaaggataatattaagttaagtgaatgttatttttgtgaaaaaattttgagtggatttttatttaggaagataaggttgatttaattttatttgttgtttaaaaagtaggattgtgttttggtgtggtaggtaatattttggaggatagattttgttttattttgttatatttttagtatttatatgggtattttattagaaagttttatttttgttttaagttttgtaatttggtgtttagtgaggggaaatatgtttgtaatttaaaaagtgaatatgtgaaaggaaaggtttttttgagagtgttgtaaaataaatgtaatgtgattatgaaaagaatatgattaatatttttgatttttattttttttgaagaaaatgtattttgatatgagttttagaagaaggaaattataaggatttgtttattaataggtattagagtatatattgtaggattgtattttatgtttaagtatttttttagatgaatttttgaaatatttttattttaaaagttattagatgtttgttaatatttaagttttgtttaagatatagaagtttttgaaattaattaatatgtttaggatatattttgtagtgttttgagggatgtgaataaatttaattatagtttatattttttaatgtatttataatttagaaaaggtagaatttagtagtaaatttaatttataattatataattaatatttaatagatattgatatgtttatttttaagaataagaaggaaattttttataagtgtatgttgaatatataataatttaaaatttatgtgataattttaggtgatgttttgagttgttttatagaatataaatatggataaaatataaaatattgaaggttgaatttaaagtgtttaatgataagtttttgataatatatttagaaattttgagaattgtatgtttgaatgttagattttataatttagtgtttagtatattgttttatatgtaatagtattttaaaaaaattaggttatagtagtataatttatatatagtaaaatttagtttttgtaaatgtatttttatgaatt

SEQ ID NO: 386 - DNA, 4479 bp, Artificial Sequence
  chemically treated genomic DNA (Homo sapiens)
tggtggtttatgtttgtaattttagtattttgggaggttgaggtgggtggattataaggttaggagattgagattattttggttaatatggtgaaattttatttttattaaaaatataaaaaattagttgggtgtggtggtaggtgtttgtagttttagttagttggtaggttgaggtaggagaatggtgtgaatttgggaggtggagtttgtagtgagttgagattgtgttattgtattttagtttgggtgatagattgagattttgttttaaaaaaaaaaaaaaaaaaatatggttgggtgtggtggtttatgtttgtaattttagtattttggaaggatgaggtgggaggattttttgaatttagaagtttagtaaaattttgtttttaaaaaaaaaaaagaattgtgtataaagattttagagagtgttaaagattagtgtatggataaggaagttttgtgaagagttgaagtgttaggtgaagaggtggtatgggggaggagggggtggaaggggagaaagggtgttatgttttataatggtttttaaatttttttgtttaggaggaaatgaagttatttgtttttagtaattagtatgatagtttttagttaagtaatttggagttatgagagttgttaggggagtaatatgaattatgatggtttttgggaattttttgataattaatttgggagttttggggtaagtttttaggttgtagtatttttgtttatgttttggttatgtttatttataattaatgggtttttaaatttaaataaaattgattatagttttttagaggaagtagtaaggttggttttgaagtttatagtattgttgatttagtttgttttttggaaggttggtagtttagtaagtatagaagtttttttagaagatagtgggttatttgttttttaaaagttgaaaggttaatttgtattttttttagtaggtagttggtattttgagtttttggttggggtagagtaaaggagttttttttttttttatttttttggtattttttttgttttttttttgttatttttaggtggatttagatttaaggtttagatttgtaaggtaggaaaatgttgtaggtttaggttgggaaagggtttaaagttgttagtggattgttgggatttagtttttttttttttattaagagagtgagttttattgggtttaaaatgattttaagttttggtttttgatattaggggaaagagatgggggtgatagaattatagaatttttgttatgtttttttaagtgtgtttagagatgtgtgtgtgtgtgtgtgtgtatatataaatgtttgtttatttttaggtaggaagggtggatgtagttatttatatatggtttgtttttttggaggataattttatttgataaataattgtttttatttgaatagaataaataaggttttatgatgaagtaaaatattaaatatatatgtattaaaaaatgtataattatttttttggaatgggttatatagagatgtgttttttaaaatgttaagagtgtaaaaggataaatagtgaaaaataaattttttttttattttgttttttagttttttaatttttttatttagaggtgagaatagaatttttatattttttagaatttttatagttagaattgtttatatgtttttattgtttttatttttatttttgtttgtataaataaatgaattgtttattatggaaattttttaaaagatttgttaatattttaataggaagtattaatagtttatgttttaggattttgtttttataattttgtaatattatattatgatatttaatttaatttttattaagttttgttaaaaatggattttaaattaagttgtaaatttttagtaatttggttttgtttttttttttttgatagtattattaaataaatttttttattgttgaaagtaataagtttggttttgttttatttattggttgtgttggtgatatttggggattgttattgaatagatgtatagagggagtttttataggtaggggtttttttgtttgtgtttttgggagagtatgttttgtatatttgttgtgttgatgaagattttatagttttattagttgtgggtaagggggtttgaggtagttttaggtaagttggggtttagtggggagaagttgtagaagaattgattagaggattttaggaggttttagagttgggtgaggtagagagttttttgtgtgtttttttttttttttgtaatttggggattttttgtattggggtaggtttttggttaggtgtatgggaggaagtatggagaatttataagttttttgattttttagtttagatgttgttgggttttttttgttggagattgtgttttttttaaatttttgtgagtgttgtggaagtatgtggggtttgggttgttgagtgttgtaagataggggagggagttgggtgggagagggaggggtggtgttggggtgggttttgatatagagtaggtgttgtgggttgtagtatagtgtggagattgtagttttggagtttgggttagggtttatttgtttttgtagtgttggtttgtgtttttttgttgtagttattggtgagtgttgtggttttgagatttttgggttggatgtgtggtggttttagtttttgagtgtttgttttttttgttttgggttgtttgggttttttgggttttttggtggttgtatggagttaaggtgttttgttttgggtgttttttgtgggtgttgatttaggttgtttggagtttggagtttagagaggagagagatagttggggagtttggttattgtgggtattttttttgtgttgtagttgtttgtttggtttgtttttttgtttttttgttttttgttttgattttttttttttttgtagagttgttgtttagtgttttgattttgttattatgagagttttgttggtgtgtttgtttttttgtgttttggttgtgagtgattttaaagtgagtgtgtttttgttttgattgatgttgtttaaggatttttgattagtattaggggagaggaggggttgtttagggagttggggttttttggattttatttatagtagggttagattttttttaggaaatgggatagggtggtagtggaggtttgagaattatgggggttggtattggttggtaagggaggaagaggttgttgggattgttttagtttgtgggtatttggtagatgaagtttgtttgggttaatttattttttttggttggaaatttatggttttttatttgagaattagatatgaatagggtgaggtgagagggagagggaagagtgggttttgggattggggttagtttatttttattttggagtttttggagtatgggatttttgatgaagtttttttttgaattttttttagggtagtaatgaattttattaagttttatgtgagtatttatttttataatagttggttgtatagataagttgggaaggttttaggggatattttttttttgttttttgttgtagggttgtgttattttttattatttttatttttttttgtttattttatttttgttttttttagtgaattgtgattgtttaaatggaggaatatgtgtgtttaataagtatttttttaatatttattggtgtaattgtttaaagaaatttggagggtagtattgtgaaataggtatggggatttttattgtaattgggagagaaatttggggatagggagggatgggtgggaggtaagagtaggtaggagttaggagttggaggtagggtgggtgatatttttatttttatgtgataagtataaatatatatatatgtttatgaaatagtggttatataaatgtgaggtggggttggaaggagattttgtttagttttttggtaggtttgaaatgatatttttaaaatgtttgttggtagttgggtatggtggtttatgtttgtaattttagtattttgagaggttaaggtgagtggattatttgaggttaggagtttaagattagtttggataatatggtgtaattttgtttttattaaaaatgtaaaaattagtttggtatggtagtggatgtttgtagttttagttatttgggaggttgaggtaggagaattgtttgaatttgggaggtagagattttagtgagttgagattatattattgtattttaattgggtgatagagtaagattttattttaaaaaaaaaaaataaaagttagttggaatgttttttttttttttatatttttttatttttttgtttttttgtagataagttaaaaatttgttatgaggggaatggttatttttattgaggaaaggttagtattgatattatgggttggttttgtttgttttggaattttgttattgttttttagtaaatgtattatgtttatagatttgatgttt

SEQ ID NO: 387 - DNA, 4479 bp, Artificial Sequence
  chemically treated genomic DNA (Homo sapiens)
gagtattagatttgtgggtatggtatgtttgttgaaggatagtggtagagttttagggtaggtagggttggtttatggtgttagtgttggtttttttttggtaaaagtgattattttttttatagtaggtttttgatttatttataaggggataggaggatgagagaatatgagaaagagaagaatattttaattaatttttattttttttttttgagatggagttttgttttgttgtttagttggagtgtagtggtgtgattttagtttattgagatttttgttttttaggtttaagtaatttttttgttttagttttttaagtagttgggattataggtatttattattatgttaggttgatttttgtatttttagtagaggtagggttatattatgttgtttaggttggttttgaatttttgattttaaatgatttatttattttgattttttaaaatgttgggattataagtgtgagttattatgtttggttgttaatggatattttaaagatgttgttttagatttgttagaagattggatagggtttttttttaattttattttatatttgtgtggttattgttttgtgagtgtgtgtgtgtgtttatgtttgttatatagggatgaagatgttatttattttatttttagtttttaatttttgtttgtttttgttttttatttatttttttttgtttttaaattttttttttagttgtagtggagatttttatatttattttatagtgttgttttttgaatttttttgggtagttgtattagtgaatgttggagaagtatttgttggatatatatgtttttttatttagatagttatagtttgttggagagaataaaggtggggtaagtgagggggagtggaagtggtaaggggtggtgtagttttgtagtagagggtagggaggggatgttttttgaagtttttttaatttgtttgtgtagttaattgttgtaggggtggatatttatatggaatttgatgaagtttattgttgttttggaagagatttgggaggaggttttattaaaggttttatgttttagggattttagggtgagggtaaattggttttaattttaaaatttattttttttttttttttttgttttattttgtttgtatttagtttttaaatggaagattatgggtttttagttaggagaaatggattgatttaagtaagttttatttattagatgtttgtaggttggggtagttttggtggttttttttttttttgttagttagtgttaatttttgtggtttttaagtttttgttgttattttgttttattttttggggagagtttggttttgttgtggatggaatttggaggattttagttttttgagtagtttttttttttttttggtgttgattagaggtttttgggtagtattagttaaagtaagagtgtatttattttggagttgtttatgattaggatgtagagaagtaggtgtgttagtagggtttttatggtggtgaggttggggtgttagatggtggttttgtaaaggaaggagaagttagggtaagaggtggaggaatgggaaggtaggttaggtgggtgattgtagtgtaggggagatgtttgtggtgattaggttttttagttgttttttttttttttgggttttggattttgggtagtttggattggtatttgtgggggatgtttgggatggggtgttttgattttgtgtagttgttggggagtttagggagtttgggtagtttagggtgggggaggtagatgtttgggagttggggttgttgtgtatttggtttggggattttaggattgtggtatttattggtggttgtggtaggagggtgtgagttggtgttgtggggataggtggattttggtttgggttttggggttgtggtttttgtattgtgttgtgatttgtggtgtttgttttatattagggtttgttttggtgttgttttttttttttttgtttggtttttttttttgttttgtagtgtttagtgatttggattttgtgtgtttttgtaatgtttataaagatttgggggaagtgtgatttttagtggaggggatttaatagtgtttggattgaggaattgagaggtttgtaaattttttgtgtttttttttatgtatttggttgggggtttgttttagtgtaaggagtttttgaattgtagagaggagagaaggtgtataggagattttttattttgtttagttttgaagttttttggggttttttaattagtttttttgtaatttttttttgttgggttttaatttgtttaagattgttttagatttttttgtttgtagttgatggagttgtgaagtttttattaatgtgataaatgtatgagatatatttttttagaagtatagatagaaaaatttttgtttgtaggggttttttttgtgtgtttgtttagtggtagtttttagatattattaatataattagtggatggaataaagttgggtttattgtttttggtagtaagggggtttgtttgatggtgttattagagggggaaaggtaaggttagattattgaaaatttgtagtttggtttaaagtttgtttttgatagggtttgataaggattgggttaggtgttgtgatatgatgttataggattgtgggaataaagttttagggtataaattgttggtgttttttattgaagtgttaatgggttttttgggaagtttttataatgagtaatttatttatttgtgtaggtaagaataaaagtaaagataatggaaatatgtagatagttttaattgtggaggttttggagggtgtggaagttttgtttttatttttgagtagaggaattgggagattggaggataaaataagaggaagatttattttttattgtttgtttttttatatttttaatattttaaaaagtatatttttgtatagtttattttaaaaagataattatgtattttttaatgtatgtgtatttagtgttttattttattatagagttttgtttattttatttagatagaaataattgtttattaaataaaattgttttttagaaaaatagattatgtgtaaatgattgtatttattttttttgtttgaggataagtagatatttgtgtatatatatatatatatatatgtatttttgggtatatttggaggaatatagtagggattttgtgattttgttatttttattttttttttttagtgttaggaattagggtttggggttattttgaatttagtaggatttgtttttttagtgggaaggaggaggttgagttttagtaatttattagtggttttgggtttttttttagtttaggtttgtagtatttttttgttttgtaaatttggattttgggtttgggtttatttgagagtgatagaaggaaggtagggagagtgttaggaaggtaggaaggaggaaggtttttttgttttgttttagttgagggtttagggtgttagttgtttgttggggaaagtataagttagttttttagtttttgggaggtaggtgatttattgttttttggagagatttttgtgtttgttgagttgttagttttttaggggatagattgagttagtgatgttataggttttagagttaattttgttattttttttagaagattgtggttagttttgtttggatttgagaatttattaattgtaaataaatgtgattagaatataaatagagatgttgtagtttgaggatttattttgaaatttttaggttagttattaggaaatttttagggattgttatgatttatgttgtttttttagtagtttttatgattttagattatttggttggaggttgttatgttgattgttgagagtagatgattttatttttttttggataaagaggtttggagattgttatgaagtgtgatattttttttttttttttgttttttttttttttgtgttatttttttatttagtattttaattttttatagaatttttttatttatgtgttaatttttagtattttttgaaatttttgtgtatagtttttttttttttttaaagataaggttttgttgggtttttgggtttaaggggtttttttattttatttttttaaagtgttgggattataggtatgagttattatgtttagttatatttttttttttttttttttgagatggagttttggtttgttatttaggttggagtgtagtggtataattttggtttattgtaagttttgttttttgggtttatgttatttttttgttttagtttattgattagttgggattataggtgtttgttattatatttggttaattttttgtatttttagtagagatggggttttattgtgttagttaggatggttttgattttttgattttgtgatttgtttattttggttttttaaagtgttgggattataggtgtgagttattg

SEQ ID NO: 388 - DNA, 4492 bp, Artificial Sequence
  chemically treated genomic DNA (Homo sapiens)
ttgtaggttgtgtttagtttttgtgtattagggatagtaaggaaaatttaagttagattagttttaggggtggtagtggtttttatttttagagaagaagaagatattttggatgggtttataggtggtaggtataagttagtttattttgtagttattatagttgttggtttttaagttgttttttttattggagaataaggatagttatgtggtgtgggatggttggtgggagttttggttgtggttatggttgtggttttgttgtgaatggtagtttttgtggttgtgatgtttaaatttttgttttttggttaaggaggggtggggtgttatgtttgagatgtagatgtggttagttatggttgtgtttatttgttttggtatattgtgttagttttggttaatgaattggggttgtttggtattagttgtggtagggaaggggtgaatgagaggttttgggggtttgaattttgttttttttagtggggttattagagtttatttgttgtattttgtttaaagatatatagtagtgaatggtagagttaggtttttgatttttagtttaatttttttttttttgtgttttttttttattatattattggtgttttgattttatttttttaggttttttaaattttttagttatagtttttttttttgttggttgtgtttttagttgtgttaggtaaagtttaaggtgtggggtttaggtagagttgagttttttttaaaaggttaatagaagtaaagtttggtttgagtaaatagattttgattgatagttttataattatagttttttttagttggtttggttttattaatattaaggggttttagtttttttgagggagaagtaagatttgttttttttttatattagaggttttgttttagaagagaagtttgaagatgtttttttagttgttttgttgtattatggtaaagtgtttaaatatagttgatagggagttgtttttatattttttttgattgggttggtgttggaattggtatttttagtattgtttttttgaggagtagggtggtgggtattaggagggttgggttagggtaagattggagattttagaggttgttgaagttaggattttttagtatgaggtgggggttaggggtgggtatatgttgaggtttgtttttagtgaaatgtgaaaggaatttaagattgttttattgtttgtttagttttttattattttttgagtatttttgaagaagtagatttgtttttggttattgtagttatgggtagggagggttaaggttgtatttatgttgtttgggatgttattgaagttgttagagatattttgggggtaattagggtttaggatattatttttaaagtgttagtattgattattttaagaggtggggaaagtgaaaaggggtatggaggttgttggttgggtatagaggtagagttttttgttttaaggtagttgtttttaggtttaggtttattgtttaggatttggagttttggggttgttttgtgtttatagagtttttattaggttttgtagggttttgggtttagtttttttgtttattttgtttttgggagtaatagtttttaaattttttttagatgttttttattttggtttatagtttttggtattttgaagaggtaggtttttttttgatagttgatgtgggtgaaggtggtattgatggggtttttgatgttttagatattttggatgagtttggggtatttaggttttattgtttttttgtttagtttatagtagtattgttttagagtggaggagatggtgtgagagtagggatgtttttggggtagatttgtatttttagtatttgttttggatttattttggaaggtaaagagggaattgtttttgaggttggtgaaggtgttgaagggttttttattgtatagttttttttttgttgggggttgaggtttttttggatgaagggttttaggttttgagtttatttttttaggtttagaggtgtttattttaggtgtaggggttttttttttaggttttagaataggtgtttgtttaggattttttttggattgggtttggaggttagaggttagggaggggttttttatttgtttatggatagtggtattgtttttttttttgttattgttatagattgtgtatttattttttggtatagtgaatatatttttgtgagttattgtagagagtggatggtagtgagtttttagtagtagggggtattttagtttatttatttgggttttgaatatattttggggtttgtatttagttgtatagtttgtgtagtagttttggtagtaagagtagagtttgttatattggtattttttgtttatgttgaagtttttagtgtagtggtttttgtatgattttatgaggaaggagtgttagttggtgttattaagtttagattatttttgttttttttatattgatttagatggttattaatatttttttgtattttggttagttagagtaatttatgttagtagggttagtatgagaaggggttttaggggtgttatggtagggtttttagtttagtgtttggtaagttgggttttggtttttttgaagtttttgttttgatgtttgaggaagggagggagaggtagagatagggaaggagggtattggagaagaggaattgttttttttgttgttttgtttgtttaatttttagtttattttttttgttttttttagtggttgttgtagtaaaggttatatttttggaatattgggtttgggtgagttgggagataagatttttgttaagtttagaattattaggttattggaaggggaattagtattgtggatttggagggtagaaagaaggtttattgggtaatagttttatttttttgagttttagtttatttttagtaaaataggattaataaagttttgttttatggggtgttgggagattatatgaattggattagataaaatgtttagtagttggagtagttataaattttttttttaaatatagttattgatttatgattgtttgattagatatatttttggttgggtgtttatttgttattatttatttagggtaggaaaaagggagtgggaggagagattgtaagtattttggggaattttattttttagtataaaagaataaagttttatttttgggttttttttttgggtgtattaatttttttaggttggaaatttgggtaaatattaatttattggattggatttaatttttgagttttttttgagtaggttattttttgtttttaggtttagtttttttatttgtaaagagtgggtttgtttaatatatttttagatttttgagagaaatatgatttttttatttggaaaatgtttattggtatgaaatatttgattttgtgtttaattttaggtgtttatagaatttttgaaatttttttattatttgaaaaaagtgattttgagattttagttgattttttttgttttgtaattagaggggattgtgatttgggttaattttttttttatgggttttagtggagttagttgtggaatggaatattaatttttattttataggtatgttgtgaggttttgttaagaaatagttataaaagggttttaagagttatgatgattgttttaattatttagtagggagggggtatttagtggtgttgtttttatgtattgatgttatgtggggtggggaggtggggtggagaatggagagtgtttttttattttttattttttttttttaagtttagtgtagggggaggtggttgtgattgattgaggggttagggaaggttggttaggggtgtgggtgtggttggggatggtttgggggtggggttgtgtaggaggttggaggagttttgtgggatttagaggtggggtgttggtttggggattattgtttttttggggtgtggttgtaggaggttggaggagttttgtgggatttagaggtggggtgttggttggggattgttgtttttttggggtgtggttgttgttgagtattttttagtttagttgagtttgtgtttaggttatgttttgttttagttgttgttttttttattttatggtgtttggagttattttttgtttgtttgttttttttttttgtttattttttgtatttgggtttgtattatttttgttaattgtttttttgattttgttgatattttttttttaaatttttgattggtatttttgtttggtatttttttttttatttttttttttttattttttttttttgattttttttgggtttttttttttttaaaatttgggtttttttgtgtggttttgtttttaggttggggatgttttttgtggttttgtgtttatggttttgatgttgtttttttttgtttataagttgtgttgtttttttgttatgttgggtttatggtggggtgttgagtggttggtgg

SEQ ID NO: 389 - DNA, 4492 bp, Artificial Sequence
  chemically treated genomic DNA (Homo sapiens)
ttgttagttgtttggtgttttgttgtgggtttgatatggtgaagaagtgatatagtttgtaggtggagagaagtagtgttaggattatgggtgtggggttgtgggggatatttttggtttggaggtggggttatgtggagagatttgggttttgggaaaagagggatttgagaggggttggggaaagaagatggagggggaggaatggagagaagggtattaggtaagggtgttggttagaagtttgggggaggagtgttggtaggattgggggagtggttggtaaaggtgatgtaggtttagatgtagggagtgggtgaaaggagagagtgagtaggtgagggatggttttggatgttgtagggtagaggaggtggtggttggaataaagtgtggtttgggtatgggtttggttgagttgggagatgtttggtagtagttatgttttggaggagtagtggtttttggttgatgttttgtttttgggttttgtggggtttttttagttttttgtagttatgttttggaggagtagtggtttttgggttgatgttttgtttttgggttttgtggggtttttttagttttttgtgtagttttatttttaagttgtttttagttatgtttatgtttttggttagttttttttagttttttagttagttgtagttatttttttttgtgttggatttggaggaagggggtggagaatgagaggatgttttttgttttttgttttgtttttttgttttatgtgatattggtatgtgggagtaatattgttggatgttttttttttattaaatggttaaaataattattataatttttaaggtttttttatggttgttttttagtgaaattttataatatgtttatggggtgggaattgatgttttattttatagttgattttattgaagtttatgaggaagaaattggtttaaattatagttttttttgattatagaatagaaaaagttagttaaaattttaggattattttttttaggtgatgggaggattttagaagttttgtggatatttgaaattgggtataaaattaggtgttttatgttagtgggtattttttaggtagagggattatattttttttgagagtttaaaagtgtgttgaataagtttattttttatagatggggagattgagtttggggatagggagtggtttgtttagaaaagatttagaaattaaatttagtttagtgggttgatatttatttaaatttttagtttggggagattgatgtatttaagagaagaatttagaaatgaaattttgtttttttatgttaaaaaataaaattttttagagtgtttataatttttttttttatttttttttttttgttttaaataaataatggtgaatgagtatttagttagggatgtgtttgattaaataattatggattaatagttatgtttggagaaggaatttgtggttgttttagttattgggtattttgtttggtttagtttatgtaattttttaatattttatgaagtaaggttttgttaattttattttattgaaaatgaattaagatttagagagataaagttgttgtttaatgagttttttttttgttttttagatttatggtgttaattttttttttgatgatttaatgattttgagtttggtaaaggttttattttttagtttgtttaggtttagtgttttaggaatgtgatttttgttgtagtagttgttggagggggtagaggggatgggttggaggttgagtaaatagagtagtagaaaaggtagttttttttttttagtgttttttttttttgtttttgttttttttttttttttttaggtattagagtggagattttagggagattagagtttagtttgttaggtattgagttagaagttttgttatggtatttttgagatttttttttatattggttttgttggtatgggttgttttggttgattaaggtataggggagtgttggtggttatttgggttaatgtagggagggtgagggtggtttgggtttggtggtattgattgatattttttttttatagagttatgtaagggttgttgtattgagggttttaatgtggataagaagtgttagtgtgatgagttttgtttttattattagagttgttgtatagattatatggttgagtgtaagttttaaggtgtgtttagagtttaggtgggtgggttggggtgttttttgttgttggagatttattattatttattttttgtagtgatttgtggggatgtgtttattatgttggaggatgagtatatggtttatgatgatggtgaggagaaaaataatgttattgtttatgaataggtggggggtttttttttgatttttgatttttaggtttagtttaaagggaattttgagtagatatttgttttgaaatttgaggaagaggtttttgtgtttgaggtgggtgtttttaagtttgaggggatagatttaaggtttgagattttttatttagggagattttagtttttagtagaggaggagttgtgtagtgggaagttttttgatgtttttattgattttaagaatggttttttttttgttttttgaggtgaatttagggtaggtattggggatgtgggtttgttttaggagtgtttttgtttttatattattttttttattttagggtagtattgttatgaattggatgaaaaggtagtgaggtttgggtattttaagtttatttgagatgtttggggtattgagggttttattgatgttgtttttatttgtattaattgttaggggaagatttatttttttaaggtgttaggggttgtgggttagggtagaaagtatttagggagggtttgagagttattgtttttagggatagggtggatagggaagttggatttagggttttgtaggatttggtgggagttttgtgagtatagggtagttttaagattttaggttttgggtagtgaatttggatttgggaatggttgttttagggtaagggattttgtttttgtgtttagttagtggtttttatatttttttttattttttttattttttagggtagttagtattggtgttttgaggatggtgttttggattttgattatttttgaaatatttttgatggttttgatggtattttggataatgtggatgtagttttggttttttttgtttatagttatagtggttgggagtgggtttatttttttaagggtatttagggggtggtgggagattgagtaggtagtggagtagttttggattttttttatattttattggggataggttttagtatgtgtttatttttgatttttattttatgttgggagattttaattttaatagtttttgggatttttagttttgttttggtttagtttttttaatgtttattattttgttttttagggaaatagtattgggagtattagttttagtattagtttagttaggaggagtgtgaaggtagttttttgttggttgtgtttgaatattttgttatgatgtagtgggatagttgggaggatatttttgagttttttttttggggtagaatttttggtatggagagagggtaagttttgttttttttttaaaagggttgaaattttttggtattggtagagttaggttggttggagggggttgtggttgtggagttattgattaaagtttgtttgtttaggttagattttgtttttgttgattttttggggaaagtttagttttatttggattttatattttggattttgtttagtatagttgagagtatagttagtagagggaggggttgtggttgaggagtttagggggtttgggggggtggggttgagatattagtgatatggtggagggaaagtatagggggaagggaattggattgagagttaaaggtttggttttgttatttgttgttgtgtgtttttgggtaaggtgtagtagatgaattttaatggttttgttggaaggggtaagatttggatttttaagattttttatttattttttttttgttatagttggtattagatagttttagtttattagttgggattggtatggtgtgttagggtaagtggatgtagttatggttggttgtatttatattttaggtatggtattttgtttttttttggttaagaaataaaggtttaggtattgtaattgtaaaggttattgtttataatgaggttatagttgtggttgtaattagaatttttgttggttattttgtgttatgtggttgtttttgttttttagtgaggagagtaatttgggagttaataattatgatgattataggatggattggtttgtgtttgttatttgtgaatttatttagagtgttttttttttttttggaggtaggagttgttgttatttttgaagttggtttagtttgggttttttttgttgtttttggtgtataagggttgaatgtagtttgtaa

SEQ ID NO: 390 - DNA, 4448 bp, Artificial Sequence
  chemically treated genomic DNA (Homo sapiens)
ttagtattttaggagttgatgagtttttatttgggtattatttttttttgggtttgagaaggttggggggaatttgtaaggaatatgtggaattttatatggtgtttttgatattgtggtaatgttagggagaggtttgtttaattggttagggttttgaaattttgattatttttttatttttgtattttgaaggttagtagagaggaggaattttgagttttttaggaggtgggtaggtggtggtagtatagatttttagatgtttaaatggagttgtagagagaaggtttttttggtagattttggaagggatttttatggtagaatttttattttataagtagggatagaggtttagatggggatagagatgtgtttaaggtaaaataatggatggaggtagggtagggagaggttaggttttagatttggttttagtattttttttatatatatattgatatagaagttggtttagatttataatttaatggttgtgtagattttagttttttatttttgttgtttatgtgtttattggtttggggttagggttttttgtttaaaggtatggatgtgtgggagtttttttgttaggtatgtgtttattagtttggggtgagagatggggttaggaaaaggttagtggtgattgtatattttgaggttagggtgatttaagagattggtgtttttaaggttgtagtttttaggttgtgggaatatgtatttggagagagggtttatattgaaatatttgaagtaggggttatgaaggtgggatttttaaggtttttgagttatgttagggggagtgtgggagttaggttgtaggggtagggggagtggttggggttgtggtataggagttaggtaaggtgtttttagggttttatttgtgtttttgaagtagtggtttttttttgaatttggttgatattattaggatttggaagttataggagtaatggttgagggttgtgttttttattttttattgagtggaagaatatgaatggtgttgaatttgttttttgagtttttttttttttgtttggtggtttaatttattatatgttttgtttttaggttttgttgtagttttttgtggaggtatttggtgttgagttttatggtggtagtttagttggaatggtagtttagtagggatataattttagtttgggtgttggttatgttattttgttgttttataggagttatttttgttggaaaatttatttttgtttttattaaggtgtatgttaatgtagtatttttgtttttaagtagttgggttttttagtggtttaggttttttgtgtttgttatgtgttagttaattagagtttgaggaaggtgggatttgggtggagttgatgttgaatggtatgtgtttgttgattggatagtagtttggtttttgtggttggatttttatatttgtttttagataggagaggggtatgtattggtgttatggttttttgtaggttgtttttggatagtttttgagagtttgttttgaagtaagtattttgtagttttagtgatttagtttttttttggattttaggttatggtaattaattttttgttgtggtttttgaattttaaggtttgatgggttttgtgggggttgtggtgaggttagggtgtttttttggtgtttatttgttttattgtttgaatttttggtattggggttgtgtttatgtggggtttattgttaatattgtttgttgggtttagtagtataatgggggttgtaaaaaaggtggggtttggtggattagtgggtgagggttttggtgagagggggaggttttttgtgttgggaggaaggtgttttagaggaggtggattttgtggggtataggtttgttgagaaggattggttaggattgtgatagaggtggggtgtttgtggtggggatggggtttgttgtaggggaggagtgtgatggggaggtggtgtttggggtatttttgtggtggaatttagggaaggagttagttggggttggggtgatgatttaggttgggttttagtatagggtttttggtgggtatgttggggttgggtggaatgtaggagagagaggaggtgggataggtgggtatttgggttggaggtagggtttgaggtgggtaggtgtagagggttgtattttttggttgaagttgggaatgaggattttgtttttgggtgggattggaggggatttgtggttgaggtgttgggttgtgatagggatattattgtttttttttttagggagatggtgtttgttgtgtatggttttttgttttttgtggttgttttttgggtaaggaaggagattgggtagtggtggttgggtgagggtttgggttttgttttttgttttgagttgttttgatgtttttgtatgttgtttgtagtttgagtgggtttggtagtatttgtatgttttgtgttgtttggtgtatgtggggttttgtttgtgaggagagatagtttttgttttttatttgtgtgtgttggtgtatatgttgtgtgtattgttttgggtttgttttttgtttatgttgtgttgggtgtgtttagatttttgttaggatttttgttttttgttgttgttgtatgtgtttttggtttttgggtttttattgttttaggttttggttttaaggtgttgtgtaggtttttttgatgatgtggagtttgagttagattagggggatttaggggtttgttgttttttgtgtgtttagattatttaggtgaggtttttttgaggaatggatggttttagagtttagatgattttggatttagtttttttttgagggaaatttattgatatgttttggttattttatttttatttttaagatgttgatgttataggatttatggttatttttgagtaaagtaggttttgtttagggtttttattattttttttttaaagaaaaggtttttttttaggttattagtattttgttgtattttagtgtggttgatagagtatgattttttttttttttttttttttttttgagatggagtttagttttgttgtttaggttagagtgtagtggtgtgatttttgtttattgtaagttttgttttttgggtttatgttatttttttgttttagttttttgagtagttgggattataggtgtttgttattatgtttggttaattttttgtatttttagtagagatggggttttattgtgttagttaggatggttttgatgttttagttttgtgatttgtttgttttagttttttaaagtgttgggattataggtatgagttattgtgtttggttttttttttttttttagatagagttttgttttgttgtggaggttggagtgtagtgattttagtttattggaagttttgttttttgggtttaagtgatttttttattttaattttttaagtgtgttattatatttgttgaatgtttgtgtttttagtagggatggggtttgttatgttgggtaggttggttttaaatttttgattttaagtgatttgtttgttttggttttttagagtgttgggattataggtgtgagttattatgtttggatatgattttgtttttaaaataatgtaatgaattgtagtttatttttgtgtgtatttttttgtatttttttttttttaatatttattattgtttggtatgttatgtgtttttttgattttattagttttttttattttaattgttatattgtattattagagggtagtatttattattgttgtagaataaagttttgtattgagttgatggtttagaaattttttttttatttatttatttatttttttttttgagatagagttttattttgttgtttaggttggagtgtagtggtgtgattttagtttattgtaatttttgttttttggttttaagtaattttttttttttagtttttagagtagttgggattatatgtgtttgttattgtgtttggttaatttttgtatttttagtagagatggggttttaattatgttggttaggttggttttaaatttttgattttaggtgattttgtttatttaagttttttaaaatgttggtattataggtatgagttattgtgtttggtttaaatatttaataaaataatggatgatgggtgttttttattgagtttttggtaattgtgagtgagtagaggatttgttttggggatatttagtgatttgttgggtgttgttgagttgtgaggaagtttaggtttggttgtagtggtgaggttgtgatttaattaattattgttgatgtttttaggatttgtattagtttagttttaggggtaaggattttaattgtttattttagtttttttatttgtaagatgtaaataatagttatttttgttttatgggatggagttgtgtaatgtttgtaatagtgttt

SEQ ID NO: 391 - DNA, 4448 bp, Artificial Sequence
  chemically treated genomic DNA (Homo sapiens)
aggtattgttgtgggtattatatagttttattttatgaggtaggggtgattgttatttgtattttataaatgaagaaattgaggtggatagttaaaatttttgtttttaggattaagttggtgtaggttttgggagtattagtagtgattgattgagttatagttttattattgtagttagatttgaatttttttatagtttagtaatatttagtaggttattgaatgtttttagggtaagttttttatttatttataattattgggagtttagtagaaggtatttattgtttattattttattaaatatttaggttgggtatggtggtttatgtttgtaatattagtattttgggaggtttaggtgggtaggattatttgaggttaggagtttgagattagtttggttaatatggttgaaattttatttttattaaaaatataaaaattagttaggtgtggtggtaggtgtgtgtaattttagttattttggaggttgaggaaggagaattgtttgaaattaggaggtagaggttgtagtgagttgagattgtgttattatattttagtttgagtgatagagtaagattttgttttaaaaaaaaaaataaataaataaataaaaagaaaatttttgggttattggtttagtgtaggattttgttttatagtagtgataagtgttgttttttgatagtgtagtgtggtagttggggtgggagaggttaatgagattaagaaaatatgtagtatgttagataatagtaagtgttaagggaaagggggtgtagaaaagtgtatataagaatgagttgtagtttattatattgttttagagatagggttatgtttaggtatggtggtttatgtttataattttagtattttgggaggttgaggtgggtagattatttgaggttaggagtttgagattagtttgtttaatatggtgaattttatttttattaaaaatataaatatttggtaggtgtggtggtatatttgggaggttgagataggagaattgtttgaatttaggaggtggagtttttagtgagttgagattattgtattttagtttttgtaatagagtaagattttgtttaaaaaaaaaaaaagggttgggtgtggtggtttatgtttgtaattttagtattttgggaggttgaggtgggtggattatgaggttaggatattgagattattttggttaatatggtgaaattttgtttttattaaaaatataaaaaattaattaggtgtggtggtgggtgtttgtagttttagttatttgggaggttgaggtaggagaatggtgtgaatttaggaggtggagtttgtagtgagtagagattgtgttattgtattttagtttgggtgatagagttagattttattttaaaaaaaaaaaaaaaaaaaaagagggttatgttttgttgattatattggagtgtagtggagtattgatggtttagggaagaattttttttttgaaggggaaatggtgaaggttttgagtagggtttgttttgtttaggaatggttgtaagttttatagtattagtattttagagatggggatagggtggttaaagtgtgttagtgggttttttttaagaaagagttggatttgaagttgtttggattttagagttatttattttttggggggattttatttggatggtttgggtgtatagggagtagtaggtttttggatttttttggtttggtttaggttttgtgttattaaagggatttgtgtggtgttttggggttggggtttggggtggtggaggtttgaaggttagaggtatgtgtggtggtggtgggaggtagaggttttggtggaggtttgggtgtatttagtgtagtgtgagtgggaggtgagtttagggtggtgtgtgtagtatgtgtgttagtatgtgtaggtggaaagtgaaggttgtttttttttgtaggtgaggttttatgtgtgttaggtggtgtgaggtgtgtgggtgttgttaagtttatttaaattgtgggtggtgtataggggtattagggtggtttggagtgaggggtggaatttaagtttttatttggttgttgttgtttggtttttttttttatttgaagggtggttatggaggatgggaagttgtgtatgatgagtattatttttttgaggaggagaatggtgatgtttttgttgtagtttagtgttttagttgtgggttttttttaattttatttgagagtggggtttttatttttggttttagttgagaagtgtagttttttgtatttatttattttaggttttgtttttagtttaggtatttatttgttttatttttttttttttttgtattttatttgattttagtgtgtttattaagagttttatgttggaatttagtttggattattattttggttttagttagttttttttttgagttttgttgtggagatgttttgggtattgtttttttgttatgttttttttttgtgataggttttgtttttattatagatgttttgtttttgttatagttttggttggttttttttaataggtttgtgttttgtggggtttgttttttttgggatgttttttttttggtatagaaggttttttttttttattagggtttttgtttgttggtttgttaggttttgttttttttgtggtttttattgtgttgttggatttgatgagtagtgttgatagtgaattttatgtagatgtggttttggtattgggggtttaggtagtagagtaggtagatgttgaaaaagtgttttggttttgttgtgatttttgtgggatttattgggttttggggtttgggaattatagtagggggttgattgttgtgatttagggtttaggggagggttggattgttagggttgtagggtgtttgttttggaataagtttttggggattatttggaggtagtttgtaggaagttgtagtgttggtatgtgttttttttttgtttggaggtgggtgtagaagtttgattgtggaagttagattgttgtttagttggtgagtgtgtattatttagtattggttttgtttgagttttattttttttaggttttgattggttgatatatggtaagtgtgaaaagtttggattgttggaaagtttggttgtttgagggtggaagtattgtgttgatgtatgttttagtaagggtggaagtgagttttttagtggaagtggtttttgtaaggtagtaaggtagtgtggttggtgtttgagttggggttgtgtttttgttgggttgttgttttagttggattgttgttatggaatttagtgttgaatatttttgtgagaagttgtagtgggatttggaggtggagtatgtggtgagttgagttgttggataaggggaaaagagtttggggggtgggtttggtattatttatatttttttgtttggtaggaggtggaggatatgatttttaattgttgtttttgtagtttttgagttttggtggtgttggttaagtttgaggggaaattgttgttttagagatataggtaaggttttgggagtattttgtttagtttttgtattataattttagttattttttttatttttgtaatttgatttttgtattttttttggtgtggtttagggattttgaggattttgtttttgtgatttttgttttgagtattttgatgtagattttttttttaagtatgtgtttttatggtttggggattataattttggggatattagttttttgggttattttagttttggggtgtgtgattattgttggtttttttttaattttattttttgttttaggttggtgaatgtgtgtttagtagaagagtttttgtatatttatgtttttgaatagaaaattttgattttagattagtgggtatgtgagtgatagaaatgagggattgggatttgtatagttattaaattataaatttggattagtttttgtgttgatgtgtgtgtgggaggggtgttgaggttgagtttaggatttggtttttttttgttttgtttttgtttattgttttattttggatatgtttttgtttttatttaggtttttatttttgtttgtaaaatgaaagttttattgtaaaagttttttttagggtttattgagaaagttttttttttgtaattttgtttagatatttaggagtttgtattgttattatttatttattttttagagagtttagggttttttttttttgttagtttttaagatgtagagatgagaaagtgattggggttttagggttttgattagttgaataaatttttttttgatattattgtagtattagaggtattatatagaattttatatattttttgtaggttttttttggtttttttaggtttaagagggagtggtgtttaggtaggggtttattaatttttggaatgttga

SEQ ID NO: 392 - DNA, 4001 bp, Artificial Sequence
  chemically treated genomic DNA (Homo sapiens)
gagtttaatgtttgtgatttttttttttttaaaaatttttgaggtaatatttatatttagtgaaatgtatagattttaagtggattattttattagtttgataaatgtttgtaaggtggaatttaagtttttattagtatttgttaaatttatgttagaggttgattagagaagtatagtttttaagatttttattttgttttgtggagaatggtaaaaatttgtgaaatattttagtagagttaggagagagtaatattggtaatgtgaagtatgttaagttaagaaaggaagtattgaaattaattgttttgaatggaatttgataagaatttgttattttatttttttaagattggatttaagttgggagagaatattgttttttgttttgtttaagttaatattattgtttagatttataaatttttttattttttaatgtttatatattaatttgtattataagttaaaataatatagagaatttggaaaaagaagaaggggaatgttttttatgaaaagtatattttttaaagtgtttggtttgagagttatatagtatgtataaaatttgataataagtatattatgatttatattgtatataataaaaagtagggtatttttgaagggttttgagaaaaagttttgggtttttaaaatttgtttaagaaggtgattaatggtatattatttttaaatgtagtattgatttgtatgttttatagttattaatagtgaaaataatagtttttaataagagttggaaatattgagttgagggttttttttttttttttaaagtttgaggttaaaattgatatttatttttttgaattatgtttatattttttttttggttaatatgtatgtggtggtataattttgaaaattatgtaatgttatagaattattatttagaaatgaattttgttaataaattttttgtatttaaattttttttattgtatagtttttgataatgttttttagataattttttttttagtaattagtatttttaaataaaaattatagagaatagtaagtttttttttttttttttggtagatttgatttagaaattgttatgggaagaaagtgttaattatattaaaaaatagtttgatagaaagtatttaaaaagagaaagggagaatattatgtttttattttggtgaattagtaataaagaaaaagattagtatggatgggtattttttaaaaatatatttttttttttttggtttttgttagggtggaggaagttgtttttttgttagagatagggtggaagagagtgaaaggataaatgattgagaggttgtttttttttattggtgtaggtgtgtgggggttggatggggggttgtggaggggggaggtggttagtaggtgtttgggttttaggtttttatttttatttttgtttttatttttatttatatttagggattggttttgttttttggtgggtgagtggtaggtgttgaagtattggggtggggggtgtaaattttgtgggtagtggaaaagaggttgtggggggttttttagtgttggtagatattgtgaggttggtagttgttggtatgtatatttagtttgtagttttgaggaatatgtttgtagttagggtgtggagtagagttttgggtaggagaattaagggagggtgtgtgttgtggtggtggtggtagtggtagtggagttgttagtttttttttttttgagtgagagaatgttatatttaggaatatagttaattagggaagtgaaagatttttataatgagaattattaaatattgtttaaagaaagtatagatgatattaattaatggaaaaatattttatgattatggataggagagagtaatattattaaaatggttatattgtttagagtaatttatggatttaatgttatttttattaaattattaatgatattgtttatagaattagaagaaattattttaaaatttatgggttgtgtttggggtgttgtttttgtagtttgtggtgtttttgtttgtgtttttgtagggttttttttgtgttgttgttgttgggggtttgggtgtttgtggtttggtgatggtagtggttgtagtgggtatggttgaaggattgggaggtggtggtttggtttgaattgttgtgaagaaagtgtaattatgttttgttttgtgggttaagaaattggagaaatttggagtgtattttgtttgtaaggtatgtgtttgttgtttttggattgtggatgggtgttaggggtttagtttgtgggattttttttttttttttgtttttatttttgttttttgttttttgttttttgttttttgtttggggttgttgtattgtggaagtgtttttgttgtttgtgtttaattagtttttttttggataagagttttgttgggtttgaagaagggggattattaagatggagagttttttattttttttgtttgaaaggagtagttttggtatttgagtttttgggttattttggggttttgttgttttgtaggagtttgttggagttatttttttgggagtggagtggtgttttttatgtggtgggtgatttaggggtaaggaaaaattttttgggggattgagtggttttttttgtaattgatttttttttgtgttttattgggaggaattgggtgtaaggagtgggggtggagaagatttttggatttttggtgttttgggaaagtgaaggggaggaaagtgtggggtgggaaggtgggtagagtttgaggtgagggttttgtggtgtttggtgtttttggttgggggtggaggtattgttgtgtgtggtgatagttttgttattattgtattattatttgtttagttaaaatgttgttttagttgtttgaggtgtaaataggatttggtaaagtgatagtttagtgtggtgggtgttattgtttagtttgaggatatttattttttgttatttattttttatgttagtttaggtattttgttatttttagttgtagatttagatgtggaggttgtgtttttgaggtgggaggattgtttgaggttgtggggtaggttggttttgtgttgttagtagtggttttgttttgatagggtgatagttgaggggggtggggatttggttttgttagtttttgtggtttgtggttgaggtagggaagagatatatttatatatatttatatttttttgtattttttttgtttgttgtaaagagggttaagtttttagattttagatttttgattgttataattaagttgtagtgattatttttgaattttgatataattataatttattttattagaatatttaggttatattttttttggtatttgtaggagttttttagttataatggaatgtttatgtttgttttttttttatattatatgtttaggtttatgttaagtatttttgtattttatattggtttaataaatatttgttgagtgaatgtaggatttagtttagtgttttttaaattttaatgtgtatgggaattttttggggaagttggttaaaatgttgattatgaattaggtggtttgaggtggaagttgagagtttgtatttttgataaatttttaagtgatgttatgttagtttatagattatattttaatttagatttggataatatattatttgttttttttgattttagtagaaaagatagaaataaataataatgttatgtggttatttttgaagaaggaatgtaaaaaagatgaagtggggagtgtgtttttaagaaaggtgtaagtttaggagttgattatgaagggtattagatgaatgagaataggatattgattgtagtaggtagaagggtgagttatgtatagaattaagaataaggttatgggtatagggtatattgtttgggtgatgattatattaaaattttataaattattattaaagaatttatgtaattaaatattatttgttttataaaaattt

SEQ ID NO: 393 - DNA, 4001 bp, Artificial Sequence
  chemically treated genomic DNA (Homo sapiens)
aggtttttgtggaataggtggtgtttgattatataagttttttaatggtgatttgtgagattttggtgtagttattatttaagtagtatgttttgtatttatgattttgtttttaattttgtatatagtttgtttttttgtttattatagttggtgttttgtttttatttgtttaatgttttttatgattaatttttgggtttgtattttttttagaagtatattttttattttattttttttgtattttttttttagaaataattatatagtattattatttgtttttgttttttttgttaaaattaaaggggataaataatatattgtttaggtttgaattggaatgtggtttgtggattagtatagtattatttgggagtttgttagaaatgtaaatttttagtttttattttagattatttgatttataattagtattttaattagtttttttaggagatttttatgtatattaaagtttgaggagtattgggttagattttatatttatttaataaatatttattgaattagtgtaggatatagaggtgtttaatataaatttgagtatatggtgtggaaaaagagtaagtatagatattttattgtgattgagaagtttttgtaagtattaagaagagtataatttagatgttttagtagaataaattatagttatgttaaaatttagaagtggttattgtagtttggttgtgataattgggaatttggaatttgggaatttgattttttttatagtaggtaggaagaatatagggaggtgtgagtgtgtgtgagtgtgttttttttttgttttagttataggttgtaggagttgataaggttaagtttttgttttttttagttgttattttgttaaaataaagttgttgttgatagtgtagggttagtttgttttgtggttttgggtaatttttttattttgggaatatagtttttatatttggatttgtagttggaggtgatagggtgtttaaattggtatggagagtgggtagtaagaaatgggtgtttttaaattgagtagtagtgtttgttgtgttgggttgttattttgttaaattttgtttatattttgagtagttgggatagtgttttaattaaataagtaataatataataatgatagggttgttattgtgtgtggtagtgtttttgtttttagttgagggtgttaggtattataagatttttgttttggattttgtttatttttttattttgtgttttttttttttttgtttttttaaagtgttaggagtttgggagttttttttatttttattttttgtatttagttttttttagtgggatataggaagggattgattgtagaagggattatttagttttttaaaagatttttttttgtttttgggttatttgttatatggagagtattgttttatttttgggaaagtgattttagtgagtttttatagagtaataaaattttaaggtagtttgggagtttggatgttgaagttattttttttaagtggaaggaatgaagggttttttgttttagtgattttttttttttaaatttagtaggatttttatttaagaagaagttaattgggtgtgggtgataagagtatttttgtggtgtagtggttttaggtgggaggtgagaggtaggaggtgggaggtggaggtggaagtgggagggggaggggggttttgtgggttgggtttttagtatttatttgtggtttgagagtggtgagtgtgtattttgtaggtggagtatattttgagtttttttagttttttggtttgtggagtggagtgtagttgtgttttttttatggtgatttgggttgagttattgttttttggttttttggttgtgtttgttgtagttattgttgttgttggattgtaggtgtttgagtttttggtggtagtggtgtagggggagttttgtgggggtgtgggtggaagtgttgtaggttgtgggggtagtgttttgggtatggtttatgaattttaaaatagttttttttagttttgtgaataatgttattggtagtttaataggaataatattgaatttataaattattttgggtagtatggttattttaatgatattgtttttttttatttatgattatggaatgtttttttattagttgatgttgtttgtgttttttttgagtagtgtttagtaatttttattatagagattttttatttttttggttagttgtatttttaggtatggtatttttttatttaggagggaggggattagtggttttgttgttgttgttgttgttgttatagtatatgtttttttttggtttttttgtttgggattttgttttgtgttttggttgtggatatgttttttgggattgtggattaggtgtgtgtgttggtggttgttagttttatggtgtttgttagtgttgggaggttttttatggttttttttttgttgtttgtggggtttgtattttttattttagtgttttgatatttattgtttgtttgttagggggtgaggttaatttttgggtgtgggtgagggtggggatgagggtgggggtaggggtttggagtttaggtatttgttggttattttttttttttgtggttttttatttgatttttgtatgtttgtattagtgggagggggtagttttttaattatttgtttttttatttttttttattttgtttttgatagagagataattttttttattttagtgggagttagaggaaaaaaaatatatttttgaaaagtatttgtttatgttaatttttttttttgttgttaatttattaaaataaagatgtgatgttttttttttttttttttaaatattttttgttaaattattttttaatataattaatattttttttttatagtaatttttgggttaaatttgttggaggaggggaaaaaaatttattattttttgtaatttttgtttgaaagtgttggttgttaaaagaaagattgtttaaaaagtattgttaaaaattatgtagtggaaaaagtttgaatataaaaagtttgttaataggatttgtttttgggtggtggttttataatgttatgtagtttttaaaattgtgttattgtgtgtgtattaattaggaaaaagatataagtataatttaaaagaataaatattgattttggttttaaattttaaaaagaaaaaaaaaatttttaatttagtgtttttaatttttgttgaaaattgttgtttttattgttgatgattgtggagtatataagttagtgttgtgtttgaaagtggtgtattgttgattgtttttttaagtaggttttaaaagtttagggtttttttttaggattttttagaagtgttttattttttgttatatgtaatgtgggttataatgtgtttattattagattttatgtatgttgtatagtttttaggttagatgttttaaggggtgtgttttttgtgggaaatatttttttttttttttttttagattttttgtgttattttgatttgtaatgtaggttaatatataaatattgggaggtgggggagtttgtagatttaaatagtgatattagtttagatagggtaaaaggtaatatttttttttaatttgagtttagttttgaggggatgaaatggtagatttttattaggttttatttaggataattaattttagtgtttttttttttagtttgatgtgttttatgttattagtgttatttttttttggttttgttgagatgttttgtagatttttgttattttttgtaaagtagggtgagagttttaaaggttgtgtttttttgattaatttttaatatggatttaatagatattaataagagtttgggttttattttgtaggtatttgttaaattgatggaatgatttatttgagatttgtatattttattggatataaatgttgttttaaaaatttttaaaaaaagaaaaattataagtattgaattt

SEQ ID NO: 394 - DNA, 4322 bp, Artificial Sequence
  chemically treated genomic DNA (Homo sapiens)
ggtaagttgttttttttttttttgagttttagtttgtttattattaaaattggtattaatagtagtttttattttttgagaattgtttagattgtttatatttagtatttagtatatagtttggtgttgggtagtttttattagtgatagttatgattatttattttttttttttatggtgaattatatggagtgggaataaaggtttggtggttggatttggagttttttaagggttagttttttttttggttgtagtttttggtatagggtgggtttattgtttatgttgagggagagattgggttggtttattgtggatttgaaggaggagttagaaggaaatttgattttaagtgggtaaaggttatttgaggtttattttgtttatttttttttttagtttaattttagggaagttatggggtatgatgggtggggtgggatgggattaggatatagaatatgttaatgaatatggttttttatttagggaagtgttgtgtattataattgggtattagggaggagggatatttgaatggatataattagggtaggtagaggtttgggggtggggtgggaaatggtatttaggtttagagaatagtatgtttaaggtttgggtgtgaagagaaagttttttttaaaggatagtttttgaatttatttggtttggttttttttttttatttattttttgtaattttaattagggtttttttatttgaataatgtggtagtttttttgttttttatttagttttttttttgttttgttgtttttttgttttatttattttgtaggagtttttttgagtttgttattttgtttggttgtaatagtttttattatttttttattgttttgtgagaagattaaagtttaatggtttgtttttgttataagttttttttttagtttaggttattttagggattgttttttatttttattttttgtgttttagttgggaagagttgtttagattttttttattttttttaggtggttttttaggatttggaatttttttttttgttttttgggaagtgatatttttttggatgagtataaggttaatgttttggttttttgagttttggggataggggaatggattttttagaattttaattggtttttagattttgagtttaggggatatttggtgaatagatgaatgagtgaatgaatgaatgaaggagttatggttgataattaagttttatgtttggaaaggaggtttaggtgtttgttaggagtaatagagaggttttaaaggtgggggtaggaaagtagaagattgttaattggggtaggggtaattgttagtttgagtaggggtagtttttagaattgtttgaggagtagtgtagtgtttgattagtgagaatttttgattttggagtttaattagtttagtttttggggtagagttgggatagtgggtttggtggtgggtattgtgtttggttgtgtttgagttttagttaataggaagagtaggagtggggttaggagaggtgggttagttggttagtggggagttttgggtgtgggtgtggggagtgggggaatttttgttggttttttttaggttttagtgggtggagggagtttttttattgggttttagtgtttttttttgtaaaatgggttttttttgagggttggttgtgtgttaatggtgggaggatgtgaagagggttaggtagggtagagggattgggagatttggtgttttgtgtaggtagaggtggagggatgttgtttttgattgtagttggtggggtgaggtttggtagggtgaggtttggtgggggtggggtttggtgggggtggggttggtggtatttgggtgaggttgtttggttttgtttttttgtatttttgtgtgttgtggtgttggagtttgaggtggttgtagtttatattttttgagtgatttttggtgtttgtttgttgtgtggaggtttgggttatattttattggttgtttggtttattttagttagtgttgtgttgaattttgtttgtgtgtgttggggagtggtgtttttgttgttgttgttgtgatttttggtgtttgtttttgtaatgggaggtaagtgagggttgggtttgggtgtgggattggggttattttgagggtgtggtgtttttttttttttttttttgttttagtttttgtttttgaaattgagaaattgagttgtggttagtgaaagttttgttgtgttgagatttgttggtgattttgtttttttgtttgtttgtgtgtttttttgttagatagtgggggttgaggtttttttgtttgtttgtttttggtttttttatttgtttgtgtgttttttgtttttttgaggggtttgtttgttttttttgatttttttttgggttttgtgtttgtttgtttgttgttatttattttgtgttttttttttgtgtgtttttttgagatttgatttttttgttttttgttatttgatttgtttgttttttgttttttgtgtgttttattgttttatttttatttatatttttatttttgtttgttgtttttttgattttgtttttttggagttgtgtttttggtttatgtttgttgttttttgttagtttagttgtttttttgttttattgtggggtttaggttaggttgtttgttgggttttgttttttgtttttgggtttttggaggtttgatttgtgtggtgttttttttttgttgtttttttttttggttttaagagttttttttggtttttttatttgtttttgggttgggtgtggttttagtttttattatttttttttttattttatttttttgtttttttgagattttttttagggtggtttttgtttgatatggtttgtatttgtttttaatttagatgttatttttgttgtgggggttttattagatgaggggaggaggttgggggggggggtttttttggttggtggtggagtggtagaaggagagtattattggaattgtttttatttttttagtttttttttttttggggtaggggagagttttattgagttttgttttaaatttggttagaaggatttgttgtgagtgggtggggggtttttttttttgatgtttattttgtatgtgtggaagttgtttttttgtgttaagttattggtatttgggtgtgtgggtatgttgtgtgtttgtgttagtttttgtgttgtttgttattgtgggatttgtttgtgtatgtgtgtttttttttgtatgtgtgatttgtttgtgtgtatgtgtgtatgtttgtttgtgttttgaggttttgtgtgtgttttttgtaattgtgtgtattatttttggtgtgtttgttgttattagatttgtgtgtgtgtgtgtgtgtgtgtgtgtttttgtttgttagtgtgtgtgtttttgtgtgtttggaggttttggtgttgtatattgggtatattatggtgattaattggttatgagtatgttagatttgttaattgtggaagtttttggtgttgggtgtttatttattagttttatgtgtgagtgtatttgtataagtgtgtgtatgtgtgtgtatttatgtgtggttttttttttgttattgagtttttgtgattaggtttatttggttattaagggaggggattgatttttggggtttttttgtttttgttgtggagtgagttggggtttggtgagtaggttagtagagggaggttgtatggtgtatgtgtgatatgtgtggttgtgtgtgtgtgtgtgtgtgtgatagagaggtgtggtggtgtttgggtagttgtatttggttgatgggtggtgtgagggttatgtgatgggatagtgttggggtaagtttgggagtgtgtggttatggtaggagtgtgtgattggtgggatatagtttatgaaattgttggtgtatgtttggggagtgattgtgattgtggggaattgagagtgtttgggtgtgggtgttagtggtaggagggggtgtgataaggtgtgtggtgatagtgttgggagggaaggtgagagtttagtgtgggggtgtgtgtgtgagtgtgtgggagattatgaggatgtgggtgtgtatatggagagggttagagggtaagttttggggtttgtagtgttgtgattaagattttgggttttgtatttaagaattatttgggttttaatatttgtttgtgtttgttaagagtaagagatttaagttaggttttttaaggttgagtgtttttatttgtagaatggagagagtgaggataaaagtttttgtgttaaaggttttttaatataattttggtt

SEQ ID NO: 395 - DNA, 4322 bp, Artificial Sequence
  chemically treated genomic DNA (Homo sapiens)
ggttaagattgtgttaaaggatttttaatataggaatttttgtttttattttttttattttgtagataaggatatttagttttgagaggtttagtttgggttttttgtttttaataggtataagtaagtattggagtttaaataatttttgggtatagagtttgaggttttggttataatattataaattttaagatttgttttttagttttttttatgtgtatatttatatttttatggttttttatatatttatatatatatttttatattgggtttttatttttttttttagtattgttattatatattttgttatatttttttttgttgttaatatttatgtttaggtatttttggttttttataattatagttattttttaagtatatattggtagttttatagattgtgttttattagttatatatttttattgtggttatatatttttaggtttattttagtattgttttattgtatagtttttatattatttattagttaggtatagttgtttagatattattatatttttttgttatatatatatgtatatatataattatatatattatatatgtattatatagtttttttttgttggtttgtttattaagttttagtttattttatagtaggaatgaggaaattttagggattagtttttttttttagtgattaggtgggtttggttatagaaatttagtggtagagggagagttatatgtgagtatatatatatatatatatttatatagatatatttatatatgagattggtgggtaggtatttaatattaggggtttttataattaatagatttaatgtatttatggttagttggttattatgatatatttagtgtgtaatattgaaatttttagatatatagggatatatatattagtaggtaaggatatatatatatatatatatatatatgagtttggtgataataaatatattaagaatggtatatatagttgtaaaagatatatatagagttttaggatataaatagatatatatatatatatataagtaagttatatatgtgaaaaaggatatatatgtataggtaagttttatagtgatagatagtatagaagttgatatagatatataatatatttatatatttagatattagtgatttagtataaggagatagtttttatgtatatagggtaggtgttagagaaggggattttttgtttatttatagtagatttttttgattaggtttaaggtggggtttggtggggtttttttttgttttaagagagagggaattggggaagtgggagtagttttgatggtgttttttttttgttgttttattattagttaggaggatttttttttttgattttttttttttatttggtggagtttttataatgggagtggtatttgggttgggggtgagtatagattgtattgggtaggggttattttgggaggggttttagaggggtggaggggtggggtgggaagggggatggtggagattggagttatgtttagtttagagatggatgaagggattgagaaagatttttgagattgaaagaagagatagtgaggaggaggtgttgtgtgggttgggtttttagggatttaggggtgggaggtgaggtttggtgggtggtttggtttgggttttgtggtagagtggagaggtggttggattggtagggggtggtgagtgtgggttgggggtgtggttttgggaggatgggattgagggggtggtgggtgggggtaggggtgtgggtgggggtggggtgatggagtatgtggagggtaagggatggatggattgggtggtgagggatagaaggattgggttttggagaggtgtgtagggggagaatatagagtgggtggtgatagatggatggatatagggtttgggagagagttgggagggatggatgggttttttggaggagtgggagatatatgggtgggtggaggggttgggagtgggtagatagaaggattttagtttttattgtttagtggagggatatatagatggatagggggatggagttattggtaggttttggtgtggtgggatttttgttgattgtggtttagttttttagttttggaaatgggaattggggtgggaagggggaaggaagggtgttgtgtttttggggtagttttgattttgtgtttggatttggtttttatttattttttgttgtaggggtaggtgttaagggttgtggtggtagtggtgggggtgttgttttttggtgtgtgtggatggggtttggtgtggtgttgattgggatgggttaagtggttagtgaggtgtggtttgggtttttgtgtggtgggtgggtgttgggggttgtttgggagatgtgggttatagttgttttgggttttggtgttgtggtatatggaagtgtgagggggtggggttgagtgattttatttaggtgttgttggttttgtttttgttaggttttgtttttgttaggttttgttttgttaggttttgttttgttagttgtaattggggatagtgtttttttgtttttgtttgtgtgggatattgagttttttggtttttttgttttgtttggttttttttgtatttttttgttattagtgtgtagttagtttttagaaggggtttattttatagaggaggatgttgaggtttggtggggaggttttttttgtttgttggggtttgggaggggttggtgggggtttttttgttttttatatttatgtttgggattttttattggttagttggtttgttttttttggttttatttttgttttttttgttggttggagtttggatgtggttgggtgtggtgtttgttgttaagtttgttgttttggttttgttttaaagattgagttggttagattttagggttggaggtttttgttggttgggtgttgtattgttttttaggtggttttgggaattgtttttatttggattggtagttgtttttattttgattggtagttttttgtttttttgtttttatttttgagatttttttattgtttttggtaggtgtttgagttttttttttagatatggaatttggttgttagttataatttttttatttatttatttatttatttatttatttattgagtgttttttaggtttaaagtttagggattagttggggttttagggagtttatttttttgtttttagagtttagaaagttaagatattagttttatatttatttaaagaaatgttattttttaggagataaaaaagagggttttaggttttggggaattatttagaagggatagagaaagtttagatagttttttttagttgagatataagggatggaagtgggggataatttttgaggtggtttgagttgagaaaggggtttgtgatagagataggttattggattttggtttttttatagagtaatgagaaggtggtgaaagttattataattaggtaggatgataggtttaagggggtttttgtgggatagatggggtagagggatagtagggtagaggagaggttggatgggggatagaagggttgttatgttgtttaggtgggaggattttggttgagattgtggaagatggatggggagaaaaggttagattaggtgggtttaaggattattttttgggaaagattttttttttatatttaggttttgagtatgttgttttttgggtttgaatgttattttttattttatttttaaatttttatttgttttggttgtgtttatttaaatgttttttttttttgatgtttagttgtaatgtatggtatttttttgagtgaaggattatatttattagtatgttttgtgttttgattttattttattttatttattatgttttatggtttttttggggttggattggaggaaagggtaaataaggtgagttttaagtgatttttgtttatttgggattgggtttttttttggttttttttttaggtttatagtaagttaatttagttttttttttaatataaataataggtttattttgtgttagggattgtagttagagggaggattgatttttgaggagttttaggtttagttattagatttttgtttttattttgtgtggtttattatggaagaaggaaatgaataattatggttattgttgataggggttatttagtattaggttgtgtgttgggtgttggatgtgggtagtttgaatagtttttaagaggtgagggttgttgttagtgttagttttggtgatgagtaaattgaggtttagagaaaggagaagtgatttgtt

SEQ ID NO: 396 - DNA, 8467 bp, Artificial Sequence
  chemically treated genomic DNA (Homo sapiens)
atgaattaaatttttttttggtattaagaagggatatatagtattttgagttttgtttttgtttttttattaagttttttttaatagttggaagtggttgaagggggttgttttaaggagattttttgttttttttttgatagttgattaaaagaaaataggttatgttttttaaatttatgtttattttgtttttaattattgtttttttaaataaaggtaatatttgtgtaattttagttagtttgaatttttggaggtaaatagagtgtaatttgttttggaagaattttgttatgtttaaggttttatgttgggtgttggtttttttgtttttaattatttttttattttgatttggattgtagaaatttttaattttttgttttttagttttatttttatttttagatttggggttgttaaataatggaaattttaggaagatgtaggtgtggtttttaaagttttggtttgtgagtgtttttaggttggttggggtgttggtttttttagaaataaggtttgaatatgtaggtgttagttaggattttttgttgtttgtttattgttgttttttttttgggatttgagagaagtgggagtgtgtgtgtgtgtgtgtgtgtgtgtgtgtgtgtgtgtgtgtgttttgtgttaggagaaaggtttgtggttgttgttttagttggtttgtttattttttgtttttaggagaagtttgtttatttgggatattagtgattttttttatttttattttattggttttatattttttttatttttttttaagttgttgatgtagaaagtatttggttattttgaaatggtagtttttggaattttagttttgttttgtaatttagtagggttttttggaagttttataattgagatttatgggtttattgggtaattaaatgatgttattgtgttaattttgtatgtattattgttgtttgtgttgtttgtgggttgttggttggttgtagtttgttggtgatgagggtattatagttgttttgattgtgtagattatgtatgttttggttttgggaatttattatgtattagaatatattagtgtttgtattttaaaaggttaaattattggtttttagttagggatttttggtaagtggtttgttagtgatgagtgtttgtttatattggtatatagtggagttttttgtttttggtttatttgtttttaggaaagttttggggtgaggtgaaggtgattgaagtaatgtttttttttttagattgtagttgtttaggggggatatagtatggtattttttattgaattttttttgtttgtttgtattttagtttttttttttttagtgatttttttatttttttttttttttttttttttgatgtttgattttagtagtaaaggaggtaaaaaaggtattgagttgttagttaaatttgaaaagtgtggttttgttttttttatagttattggtagttttttgtggaaggtttgttttttggggtagttgtggttttggagtggttgtgtttggtgtttgttgggtgtggttttgttttaggtttgggagggtaggttggttgttttggtgagtggtagagtttttttggatagtttttgtttatttaaatagaagatgttggtgttggagtgggtttggatatggtgaggttgtgagttggtttgagtggtggggtttggtgatttttttttttttttttgttttttttttttttttgtatgtatgttttgtttgtttttattttgtttttattttgggtgagtttgtttgtagtttggggtgtatatttgtatgtgtatttttttttatttatttttgtgtttgtttttatttttgtagttgagttttgttatgtgtgttttgtttgtttgttggttgtttttgttgtttttgttgtttttgggttttgatggattgaatgaaggttgtttatattgtttattgatgttttattaaagatttagaaggttgtgttatgaatttggagttgataatggaaagtttgggtattttgtatgggttggttggtggtggtagtggtgggggtggtggtgggggtggtgggggtggtggtgggggtttgggttatgagtaggagttgttggttagttttagtttttattatgtgggttgtggtgttgttggtttgttgtggggttttttgttgtttttaattgtgtattaggagttgggtatggtggtagtggtggtagtggtggtgttgtgtttggttatggttattagtatggttttgattttggatggtggtgattattggtttgagttttttattttgttgtattatgttatgagtatgttttgtgatttgtttttgtttggtatgggtatgagtaatatttatattatgttgatattgttttagttgttgttatttatttttattgtgtttgataagttttattatttttatttgtattattatttgtattattattattattattattattagtgtttgtttggtaatgttagtggtagttttatttttatgtgtgatgagtgtgggtttttggttatgaataatttttatagtttttataaggagatgtttggtatgagttagagtttgtttttgttggttgttatgttgttgggtaatgggttaggtggtttttataatgtgtagtagagtttgtttaattatggtttgttgggttatgataaaatgtttagttttaattttgatgtgtattatattgttatgttgatttgtggtgagtaatatttgttttgtggtttgggtattttatttgtggttatgatgttgtatttgaatggtttgtattatttgggttatatttagttttatgggttggtgttggtatttagttgtgagtggttatttttgtttttattgggtttgtaggtggttatgttgggttagttggaagaaattaatattaaagaggtggtttagtgtattatagtggagttgaagtgttatagtattttttaggtgatttttgtgtagagggtgttgtgttggttttaggggattttttttgatttgttttggaatttaaaattgtggagtaaatttaaatttggtagggagattttttgtaggatgtggaagtggttttaggagtttgagttttagtgtatgtttgttttatgtttggtaggtaaggttggggttagttaggggttaggttgttgggaagagggttttgggtttggtgtttgtggtttaagtttgtgtgttgagttattttttttgatttttttttttttttttttatatatgttttttttttttttgtttttatttttttttttatttttttttttttttttgttttttttttatttttttttttttttttttttttttttttttattttttttttgtttttgagtttttattgattgatttttttttattttatttgttttttttttaatgtgttaatttttgttttatttttgatttttttaggtattgggaggtgggatgggggtgtgtgtttttttttaggagttttgtttttttaagatttatagaaattaggatttgtttttatttaaaattttatgtattttaagttttttttagataatatattttaattttttgggttgattagtttttttgtgtagaggtagttgagaggttttgttttgtagagggaaaagagttttttatttttttatttattatataggtaaatttatttggttattggttgaaggtatagttttgtttttgtggggaattggtggttaggatataatagtgtttttggagtttatttttggttttggtgttggtgtagggattttttgattgggtttgaggggtttgggttagttttaatgttattatttatagtgagggtagggtgtaaggttgagaaggttatatttattgttttgggaggatgtgggagaagagattgaggtggaaagtgttttgttttgtttattggttgtttttgttttggttttagtgtttgttgggatttgttaggatttgttggggttttgggagattttgagtatttgtaggaagaggtgttgagaaattaaaaatttaggttagttaatgtatttttgttgttggttgtaggttttgtttttgtattaagtgggtgttgattgtgtgtgtttggtgattgtggggaggattggtggtttgtgggaggggatgggtagaggtgtgggttatattgttttggagttggtttggttttttgtgttttttttagtggttaagttgtgaggtatagttttttattgttttaggagtatagaaattttttgtgtgggtggtgggtgtgtgagttagagggaaagatgtagtagttattgtgattggtatgtagttgtgtgtttttgtgtgtatggattttgtgtggtgtgtgtggtgattgtgttgtttttaggagtaagttatgggtttagaggggtaaaatgtttaggttttttgttgggaaggatatattatattttatggtaagttagggtgggtgattttttatggattgggtggaggggggtattttttaggattggtgggtggtttaggggaataatttgtggtggtgatgatttgtatagtgtgggttttgggatgtgtgtggttttgagttagttttgtatagtttgtttttggagttgtgagtttaggtttttatttttgattttttgggttttttttgtattgttgagtttagtttgtggggtgtatttgattaatgtttgatagggttggggaatgtgataggtagtaggtttatttgggtttggggagggggagtttttgttttgatagtatttttttttgttgtttgttggtggatttttatttttagttggtaattgttttgtagtgttgatttaagaaggtaaagaaaattaggtttttttgtaaagagttttttttaaattggtggattttggatattttgagtggatttagaaatttatgtaattttttttttttagtttattttttatttttttttatagttttttttgatttgttgttggtttggggtaagataaagtagttagtagagagtgataataatagtggtgggaaatgaattggagattggttgatagtttttaatattttgttatagatttttttgaatgttttaggttgtttttggtgggttttagtatttgttggttttttgggtattggggattagaaggaatttggtagttggttttaggggtatagttaaaggtaggatgatagttatttttttgtttattttagagtgttgttgtttttttatgttggttgtgtaaagaatatagtttttaaaaaatatgtgttttttgtttatataggtttgaaagtgatgaggaaagtaatgttttgtttattagtgagttttagtttttaaaatgattttaagtgttgttgagatgagaaagtgtggtattttgggggtttttagttttatttgtgtttatggtgtaagtttgtagggataggtttgggatagtattgtttatgttgttagattttttgtagaggattgttgaagttgtttttgtgggagatagaatgttttttttagtgagtggaaaaggtttgttgaggattttgttttgtttgagtatttaaatgtgtgtttgttttattattttgggttgaaaagggataagagttttagtttttttatttggttattttattagtaattataagtgtgttgagtggttattattatataggaggttttttagtttggggttagtagattagtttttttagatattgatgtagaagttgggattggtaagtaggtattatgtgtttggagtgttaggggataggagtaaatggagaagaaaagtggaggttttttttgtttggagtattgattggaatttttgttggtatgttgtagagggtttttgttgttgggttttgggggtttaataagtttagttgttttgtaggtggtttggttggatttttagattggtgtttggaagatattgtttttgttttttttttgttaaatttgtttttttttttttttttataggttataggtttttttttttttttattttggttttgtttttgggttttgttaaatagttaagtaggttggggtttagggggtttagaatgaagaggtttgatttggttagtgttggtaaagtttatttttaggtgaggttataatagaggtaggttttttttgtttagtttgttggtgtagttatagttaagggtggtatttgaaaggaaaagggagaaaattttggagaaatttagattgttttaatgttagattttagagaaattgattttaaatgtatggatttgtttggaaagggtggttaagtggtaggtggttgtaattttgtttggttgggtttttgtagaggttttttaagattagtttttgtagggtggtttttagtaatttgataagaggtggttaagataaatttttgtgggtttgagtatatatttttgggtgttgggttttagagatttttaaattaagtataaataagaagggagtgagagaatttaggttagaatttgtatgggtattttattgaggaaaagtgaggttttggtggtaggtatgtttttttttgatgtttgaaaattgagttgagtgtttgattatatttattgtagaggtttttgtttttagtgagtttggattttttagtggtttgtttggagttggtttttagtttttgttgtagtttgatgtatggtttttttttggtagtaagtttttagtggttagtttgaagttaattttgtttaggtggttgagggtttttagttaatttattatgatgttgtttgggttatttgatgtttgtagtggtgggatatggtttgggtagtgtgtagtggtttttgttaggggtattgtgtgtgtgtttgttttttgttgtgttggggatgtttttgggtgatatgggttgttgggtattttttaagttgaggaaatggattttttttgtagagttttgtgtttattttttaattttttattttgttttttgttgttagggtttttgatttagtttattttttttggtggtttagttagggattagagttggagaggttgaatgtaatttgtgttagtatggaatagatgatatgtttgtttgttagttgtttggatgaataattgaaaagtttgttgtagtttgtgttttgttaagttttgggtgttgggagaatatttttttaatatgtattagggtgggtgggagtgggtagaggaggtgggatttgagggaggagagtgaatttgagtaggagaagtagtttaggtagttaggtgtttttgatgtgagaggttgggtatttatttttattttaggttttttattgtgtggttatgttatttttttaaataaatgtgtatatggagggagattgatgttgataatgtttagaagattaaaagagtattaatgttggtaataataatgtaaatgtgtggatttagattttattgatttggaatttgatttggtgtgtttttagtaagtttgatggtgtgttttttttagtagagtgtttattagtgttatggttttgtggttttttagtggtgttgttttgttagttttgtgtgggtttttttgtttgattgtagttttttttttgtgaggttttagtttgttttatttttttgaggtttttttttttttttgtggggttttttgttttttgtatttttttttttgatttttgtattatttgtttttgtgtgtatatattgttatttgtgtttttggtgatttgtttgggtggttgggtttgtgaagttaatgtgttgaatggtgtttgagtttttttaattattttgtgtttggttgttgttattgggttttggtgattaagtttaagtttgaaaatgatgtggttaaagttgtttgttaatggtagagtttaattagttgtagatttttttttatttttattggtttttgtattaaaaaggtttatgtgtagattttttatgtaggtgtatttgttggataattaaatgtggttttagtaataaaagtttgagttttatttttttgagtagtaggttttgtgttggattggttgggtttaatagggagaattttgtgttttattttggttgggataggaagtaagagaagtaaattggggaatttttgttttatttttttttattttttggatgttttgggttgaggtttgggttattggtttattgtgggtaaggaggtgttttgtggaatatttgtattgattggaaaagaaagaattttaaagttttttttttttgtttgtgggggatattattatattttgttaattatttttttggttaaatggtggtttgtttttttagaaggagtattaaggtgaattttatggaaaaaaaataaaagattagggatttaagtgggagtaggatgagaattaattttt

SEQ ID NO: 397 - DNA, 8467 bp, Artificial Sequence
  chemically treated genomic DNA (Homo sapiens)
aagaattagtttttattttatttttatttaggtttttgattttttattttttttttataaaatttattttagtgttttttttggaaaaataagttattatttggttaggggagtggttggtagggtgtggtggtgttttttataagtgggaaggaagagttttaaagtttttttttttttagttaatgtaggtgttttataggatatttttttatttgtgatgggttagtgatttgggttttggtttaggatgtttagggggtgggaaggggtggggtaggggttttttagtttgttttttttattttttgttttagttaaggtaggatataagattttttttgttagatttgattagtttagtgtagagtttgttatttggagggatgaagtttaggtttttgttattagggttatgtttaattgtttaatgaatgtatttgtgtaaaaagtttgtgtgtgagtttttttagtatgagaattgatgaggataggaggggatttgtggttgattaagttttgttgttagtaggtagttttagttatgttatttttaaatttgggtttagttattagggtttagtggtaatggttaagtataggatagttaggaagatttgggtattgtttagtgtattggttttgtggatttagttgtttaggtggattgttggaagtgtaagtagtggtgtgtgtgtataggggtgggtggtgtagaggttgggggagggggtgtagagggtagagagttttgtgagaggaggagaaaattttggggaagtaaggtgggttggggttttgtgggggaggagttgtggttagatgggagaatttgtgtagagttggtgaagtggtattgttggaaaattgtggggttgtggtgttggtgagtgttttgttgggaagagtgtgttgttgggtttattggaaatgtgttggattaagttttagattaatgaaatttgggtttatatgtttatgttattgttgttagtattaatgtttttttaattttttaaatattattagtattgatttttttttatatatatatttgtttgagaaagtgatataattatatagtggaaagtttggaataaaaataaatgtttagttttttgtattgagggtgtttggttgtttgggttgttttttttgtttgggtttattttttttttttgggttttgttttttttgtttgtttttgtttattttgatgtgtgttgggaaggtgtttttttggtatttgggatttgatgaagtatagattgtagtgaattttttaattatttatttaagtagttagtaggtaaatatattgtttgttttgtattggtatgggttgtgtttagtttttttagttttgatttttaattaaattgttaggagaggtgggttgagttgggagttttagtagtgagaaatgaggtgggaggttggggggtgggtgtgagattttgtgaagggggtttgtttttttggtttgggaggtgtttagtggtttgtgttatttaaggatgtttttggtgtagtgggagataagtatgtatgtggtgtttttagtaggagttattgtgtattgtttgggttgtgttttgttgttgtgggtattaggtggtttaggtgatattatggtgggttggttaagggtttttggttgtttgaatagaattggttttagattggttgttgggagtttgttgttaggagagggttgtgtgttggattatggtggggattggagattagttttgggtaggttgttgggggatttgggtttattggaggtggaaatttttgtagtaaatgtagttgggtgtttggtttgatttttgggtgttggaagaaaatatgtttgttattgaggttttgtttttttttagtgggatgtttgtgtaagttttagtttgggtttttttattttttttttgtttgtgtttggtttagaggtttttggggtttaatgtttgagagtgtgtgtttgaatttgtagaaatttgttttggttgttttttgttaggttgttgaaaattgttttgtaagggttggttttggggaatttttgtgaaggtttgattgggtggggttgtaattatttgttatttagttgttttttttgaatgaatttgtgtatttggagttaatttttttgaaatttaatgttggggtaatttaaatttttttgaagtttttttttttttttttttaagtgttatttttggttgtgattatattggtaggttgggtaggaaggatttgtttttgttgtgattttgtttaagggtgagttttgttggtgttggttaaattagatttttttattttgagttttttaaattttggtttgtttggttgtttggtaggatttgggggtggggttaaaatgagagagaaagggaatttataatttatgagagaaagagaagaggtaggtttggtgggaggggggtagggatggtgttttttaggtattggtttgagagtttggttgagttgtttgtggagtggttgggtttgttaaatttttggggtttaatggtgagggttttttgtggtgtattggtggggattttgattgatattttgggtggagaaagtttttgttttttttttttatttgtttttgttttttagtgttttgagtatataatatttatttattagttttagtttttgtattagtgtttgaagagattgatttattgattttaaattgaaaagttttttatgtaataataattatttaatatatttgtagttgttgataaaatggttagataaaaaggttaaagtttttgtttttttttaatttagggtaataaaatagatatatatttgaatgtttgagtaaagtggggtttttagtaggttttttttatttgttggaggaggtattttgttttttatgaaggtagttttagtgattttttgtggaaaatttagtagtgtgggtagtgttgttttgggtttgtttttgtagatttgtattatgggtgtgggtggggttgaggatttttgggatgttatgtttttttattttagtaatgtttgggattattttaaaagttgaaatttgttaataggtgaagtattattttttttattatttttagatttatatgggtagaaggtatgtgttttttaaaagttgtgttttttgtgtgattggtatgagggggtggtagtgttttgagatgagtaggagaatagttgttattttgtttttaattgtatttttaagattagttgttaagttttttttggtttttggtgtttaagaagttggtgggtattaaaatttattagagatagtttgggatatttggggggatttatgataaaatgttaagaattgttagttagtttttagtttattttttgttgttattattattgttttttattggttgttttattttgttttgaattaatagtaaattagagaaaattgtaggagaggatgaaaaataaattaaaggagaaagattatataaatttttaaatttatttaaagtatttggagtttgttgatttgggggaggttttttgtagggaaatttagttttttttatttttttagattaatattgtggggtgattattgattgggaataggaatttattagtagatggtaaaggaaaatgttgttaaagtggaaattttttttttttaagtttgggtgaatttgttgtttgttatattttttagttttgttgggtgttggttgagtgtattttataagttgggtttagtggtgtgaggaaagtttgggggattgggggtggaaatttgagtttgtagttttggaagtgagttgtgtgaggttggtttggaattgtgtgtattttaagatttgtgttatgtaaattattgttattatgaattgtttttttagattgtttgttgattttgaaagatatttttttttatttgatttatgggaagttgtttattttggtttgttatagggtatagtgtgttttttttagtgggggatttggatattttgtttttttgggtttgtggtttgtttttaggggtagtgtagttgttatgtatattgtgtggggtttgtgtgtataaaagtgtgtaattgtgtgttagttgtagtaattattgtatttttttttttagtttgtgtatttgttgtttatataggaggtttttgtgtttttagaataatagagggttgtattttgtagtttggttgttagaggaggtataaagagttgagttggttttagaataatgtaatttgtgtttttatttgtttttttttgtgggttgttagttttttttgtggttgttaggtgtgtataattagtgtttgtttaatgtaaaggtggagtttgtagttggtggtagggatgtattaattaatttgaatttttaattttttagtatttttttttgtgagtgtttagggttttttggagttttggtaaattttggtaaattttagtaaatgttgggattggggtaaggatggttggtgagtaaggtaaagtgttttttattttagtttttttttttatgtttttttaaagtggtgaatgtgatttttttaattttatattttgtttttgttgtaggtagtgatattggagttggtttgagttttttaagtttggttagaaagtttttgtgttaatgttaaggttagagatgggttttaggagtgttgttgtattttggttgttggttttttgtgggggtaaggttgtgtttttagttaatgattaaataagtttgtttatatggtgggtgggagagtagagagtttttttttttttgtagagtaaagttttttaattgtttttgtatagggagattagttagtttggaaaattgaaatgtgttgtttaaaagagatttgaagtgtatggggttttgaataagggtaggttttggtttttgtgggttttggaaagatagggtttttagaggaaaatgtatatttttattttgttttttagtatttgggaagattggaaatagggtaaaggttggtatattgaggggagggtgaatgaaatgggggggggttggttaatgaaagtttagggataaggagagagtaagaaagaaaaagaaaagggagaagggaaagtaggggaagagtggaagagaaagagaaaatggaagaagaaataaaaatgagaagaaagaggatgtgtataggaaagagaaggaaagaattaagagaagtgatttggtgtgtagatttgggttataagtattggatttggagttttttttttagtagtttggtttttggttagttttggttttatttgttaggtgtaaggtggatatgtgttggaatttgggtttttgaagttatttttatattttgtggaaggtttttttgttagatttgagtttattttatggttttggattttggagtaggttggagagagttttttgagattggtatagtattttttgtgtaaagattgtttgggggatattgtagtgttttagttttgttgtgatgtgttgggttatttttttggtgttgattttttttagttggtttgatgtggttatttgtgagtttgatgaggatgagggtggttgtttgtgattgggtgttagtattggtttgtgagattgagtgtggtttgggtggtgtaggttgtttaggtgtgatattatggttgtaggtggggtgtttaggttgtgggataggtgttgtttattgtgggttagtatggtagtgtggtgtgtgttgaagttggggttgagtattttgttgtggtttggtggattgtagttgggtagattttgttgtgtgttgtggaggttgtttagtttgttgtttagtggtgtggtggttagtggggataggttttggtttatgttgggtatttttttgtagggattgtagaggttgtttatggttgggagtttgtgtttgttgtgtatgagggtgaagttgttgttgatgttgttggataggtgttggtggtggtggtggtggtggtggtgtggatggtggtgtgggtgagggtggtggaatttgttagatatggtggagatgggtggtagtggttggagtggtgttagtgtggtgtaggtgttgtttatgtttatgttaggtggagatgagttgtaggatatgtttatggtgtggtgtagtgggatggagagtttgggttggtagttgttgttgtttaggattgaggttatgttggtgattatggttgagtgtgatgttgttgttgttgttgttgttgttgtgtttagtttttggtgtgtggttggaggtggtggagggttttgtagtgagttagtggtgttgtggtttgtgtggtgggggttggggttggttagtagtttttgtttatggtttgggtttttgttgttgtttttgttgtttttgttgttgtttttgttattgttgttgttggttggtttgtgtaaagtgtttagattttttattgttagttttgggtttatggtgtagttttttaggtttttggtgaggtattgataggtggtgtaggtagtttttatttagtttattagggtttgggggtggtgggggtggtgggggtggttggtgggtgggtaaggtgtgtgtggtggggtttggttgtgggagtgggggtgggtgtgggagtgagtggagaggagtgtgtgtgtgggtgtgtgttttgggttgtgggtgggtttgtttggggtgggggtggggtgggggtggatggggtgtgtgtgtgggagaggggaggggatggggagggagggagggattattgggttttgttgtttgggttggtttgtagttttgttatgtttgagtttgttttggtgttgatgttttttgtttgggtgagtgggagttgtttagaagggttttgttgtttgttggggtagttaatttatttttttggatttggggtggggttatgtttgatgggtgttaagtgtaattattttgaggttgtagttgttttgggaggtgggttttttatgggaagttattagtggttgtggagggggtggggttgtattttttaggtttggttgatggtttggtgttttttttattttttttgttattggaattaaatgttaaggagagggagggaggagaaggtgggggggttgttggggagagggaggttggagtgtgagtgagtgagagagatttggtgaaagatgttgtgttgtgttttttttgagtagttgtgatttgggggaaggggtattgttttaattgtttttgttttattttaaagtttttttggaggtgagtaagttgggagtaaaagattttgttatgtgttagtatagataaatatttgttattaataagttatttattgagagtttttagttgggagttaatagtttagttttttaaaatgtaggtgttaatgtattttaatgtatggtaaatttttgaggttgggatatgtataatttatgtggttagagtaattgtagtgtttttgttgttagtgagttgtggttggttggtggtttatgggtggtgtgggtagtagtaatgtatgtaaagttaatataataatattatttaattatttggtgagtttataaattttagttatgaggtttttgaagagttttgttagattgtaaaataaaattagaattttgggagttgttgttttaaggtgattaagtgttttttgtattagtgatttggaaagaagtggggagagtgtagaattggtgaggtggaggtgaggagggttgttggtgttttaagtgagtaaattttttttgggggtagagagtaagtaaattagttgagatggtaattatggattttttttttaatatgagatatatatatgtgtatatatatatatatatatatatatatatatttttgttttttttaaattttgggagagaaatggtggtgggtagatgataaggaattttggttgatatttgtatatttaaattttgtttttgaaaagattagtgttttggttagtttgagaatgtttataagttaaggttttaaaaattgtatttatgtttttttagaatttttgttgtttggtaattttaggtttggaggtgggagtggaattgggggatagagagttggagatttttgtagtttgagttggggtggaggggtagttgaagatagagaggttaatatttggtataaagttttaaatgtaataagatttttttaaagtaggttgtgttttgtttgtttttgaagatttaagttagttgaggttgtgtagatgttgtttttgtttaaagagatagtaattaaggatagggtggatataagtttgagaagtgtgatttatttttttttgattagttgttaaaagaagagtagggggtttttttaagatagttttttttaattatttttagttgttagagaaaatttgataagaaaataagggtagagtttggaatattgtatgtttttttttggtgttagagaaaggtttgatttat

SEQ ID NO: 398 - DNA, 6456 bp, Artificial Sequence
  chemically treated genomic DNA (Homo sapiens)
taaaattttttaaaattgaaaagaagaaaggggtaattggagaatttttattttttttggttgttttttttaagttgtttagtttttatgaatagtatttagttttattgttattattaataatttttaaaattagttaatgttttggtttttagtattggaaagttttttaaataggatattggaaatttttatttataagtttggggtggtgggtggggtggggaggtggagagagagttgttatttataggtttttattttggtttgaagatttaattgtagttattagagtaagggaatgtttattttttggtatttgtttgttattttttttttttttagagataaatatttttttgttttttttaaaaaagtatatattttaaagtaagaatgtgattttattttttttttttgagtttatgtttgttatttttaggaatagtgtgtggattagggttagatgaattttaatttgggttgtagatttatgaggttttgttttagtgttaaaggtttttggtagtaaatagtgagtaaaatagatatttgttttttgatggattttgttgttttttttttttttttttaagttatttattaaaattatatatattttgtaaagaaaaagggaaattggtagtttttgtagaggaagttggtggtattgtttagagttataaattgtatttttaaatagttttttttttggtttttttttttttgttttattttttttaaaatttagattgtaaaaaatatatttattgatatttattttattttaaaaaaagaagagaaaaagtaaagtgttataagattttttttttggaaattataaattgaaaaaaaaatttataaaagattaaattttggtgggttgtggggtggtgggggttggtggggagggggtgtggagtggagattggttttttgaggtggttaggggttttgtgatagtttgggatttttagtatttggtttggggttatttatttgtttaattgttaggattttttatttttaaattttagttattaatataattattgtagaagggaatataatatagagggtttttttttatttttttaaaaaattggtttggttgtgtttttgttttttatgggggagttttaaaatttattattgtaatattagttttattttttgttagggttttaataatatggtattataaaggtaatgtaatttatagtttttaagatatttattatggttattatatttggtagtggggtggtttttagtttttgttgtttttttgttttttttttttgtttgtttttggagtttagttgatttttgaggttttaattttatttattttttttttgggttgttgttgttgtgtttttttttatttttatttttttgaggagagttataggttgtaaatttaattaattttgtaatttatttttgtaaaattatttataaagattttttttttgtgtttgtgtttgttttttttgtgttgggtttttttagttatggttataaagtgtttttttttttttttgagttttgtatataaggaatgtgggttggggttttgtttgtttttttttttgtttaaggtaaggattttgggaatttgaagtttggtgtttattatgtttaggtttgtagttttttttttatagagtttgtattatgggaaaaaataaaataaaatttaggaaagggaggtaatagttattgggagttaatatagagttatgtagtgtttaaaatataaatattgtagtggttagaaattttgttattttttttgtttttttaggttgttttgttgaggttttttgagtttttttgtatattgaaaggtattgtaggtgtagtgtgtattttttttttatttattttaagaagttttgttttgttattagtttttttttttgggatgagtagggagagtgtgtggaggtttttgatttttttgattataattaagaaagaataatttttaaagtgtttaatatttttgtttttaagttttttaaaatataggggtagggaatattaaaatatttggtttttattaggaagattatggttttgaaaggaaatagtagatatgatattttattttatttggatttatgattaaaaaaataaaaataaaaatttaaagagtttgtttgtattttttttttttaaattttggtttggtttgaaggtagggaatttaaaagattgaggttgatggaagagagttagtggggtgagtgagtgggtagtttttttttttgttttttggagttatttagaaggataggggaagggaaggaagaagaggtgaggaaaaagaggagggagggaagtggaggttaggagtgatggagtaaggaaagtagtttgtaagtgagaaaagagggaaaaaatatagttgtatgaatttagagagattataagttgtatgtaagtagtagtagaaagagtgagagtgtgagtgtgtgttttttttgtggtttggggttagatagtttttagattagtttgaattattttttaagtattgttttgttttttttgttttggttgttttttaatttttttttttttttttttttattttttttttaaaaattaaaataatataagggagggtggtaaaagtttttttaaattggttgatttatttaaagataataataataataataaatatataataatttatattttatggtgggagagatgtgggattaatttttggtatttattttaatatttgatagttagaataaataaatatatatatttatattaatagatatatatagaaaatttggagttaaagtatttggtaagagtggaaaaaaaaagaattaaaaggtaaaataatgattatgagtagtggtggtggtagtggtattagtggtaatagtggtggtggtggtagtagtagtagtagtggtggtagtaatagtaataattatttggtgtttggttttttttagaaattttttgtattattatttttaagaattttagttttaagaattaatagagtttaatttttggaatttgagttttggattttattattgttatgtggtaggggaggatttggtgttagttttttgagatttttattgtttttggttaattaaaagtttttaaagttataagatttttttattggttggtatattttgaggtttttataagtagagtgttttggatttggaggttttggtttgaggtttgaggggtttgaaggtggttttttttttttgggtttaagatgatggtatggtttgttttgttattattatgtgggttttttttttgtgatgttggtgtttttgttgtagtaaagtttggtttttggaattttgagaattaatttgttatttggtgatataagagggggagtgtgttttgtttttttggggtttggggttaatttttttttttttatttataaatttagtagattgagttaaatgtataaaagggagtgagaggtttgaattattgggaaaagtatgttatatatatagtagggttagagaggtgagtaagagaaaaataaaataaaataaatattatagttttttttaattagaatattaggtattatgagaaaaatatttgttaagtagtttttggtgggtttatttgttttatttttatttaggataggggtttttgttgttgttttgggtttttttttttttggtgtggtggtttgggatttttggtttttgtattttgatggtttatggatttttgtttttgattttttgttttttgtaagtttgtggtgttatgtaaattataggattggtattggttggatttttttgtatgtgttttttttttttttatttaattttttaagtgttttaaagatgtattattttaatattaatattattgaaagaagtttaaatttttggttatatgtaataattttagtttttatttttttttttttttttttttttggtgtaatttttttttttttttttggatttttgttgaagtgtgttttttttgtattttagagaaatgtttaaaggatttgttttggtttggtttgtttttttttaggatagtaagtggtgggtttaatttgttattgttgatttttgggaaattttttgttgtaagaaatgtgtgtgtgggggggagggtgggggtggtggggtggtatgtgtgtgttttttataaaattttgtgagttaaatatttgtttgtgttttgtttttttttaaggttttgagatttttgtttttgaggtttgttttaaggttgttgtaaaaaaatttttttagtttgtgtttaagagattagttggagggaattttaaaggtttgttgtgttagtattatagatattgtttgtatttagaatagattgttataattataatgtattatatgtagtatagtttttttagttttgaagttgagttggggggtggggtggggggggggtagagaagaaggagaaattttttttttttttttttttttattattttttttttaaaggtaattgtagtgtagaattattttattgtgggttttagtttgtttgtttagagttgttagtttttttatttaaatgttggtttgggttttttttttttttatttatttttgaataagggagatttttgttttttttatgttttttttttaaaagaagggtgtgaggggaaaataatattttagattttttaagaattagtttaaaatgtttggattagaagtagtttttaaaggttaggttgttttgagttttggttatgagagttttttaagtgatttattaaattatagatgaatttttaaagtttttataaaattttgttatttgttaatttttaataaagatatgtttaaaataatttatttattttaatttaaaatttgggtttataatggaggagtgattagagttgtgaaagattgttgtttgttgggatatttggaaaattttttttattgatagttttgtaagaagttttatttattattgaaaatgttgttggtaatgtatttttttattttataatatatatatatttttaaaggttgtattttaggttttaaaatttagaaaggtgtaaagaggttgattattttttataagggttggagtttaggaaatatgtgttaaagtgtttgtttttgtgaaatttgaatattttaatatttattgatagatggattattgtagtttttgtagaaaagtttgttttgtgaatggtttttgaaaaatatatataggtttaattttgttattgttgttgaaatgtatgttttatttttaaagatatatgatattgttaagtttagatttattttgttagaaggtagattatttgtttttttatttgagttttttttttttttatttttaaagaaattaaaatgaattttgttggatgtaaaatgatattttgattttgtggaagggattttttttgtgtgtttatatgtgtaatttttttttttatgagtaattagtattttaggattttttagatgtatttatatggtttggaatgtgaattgtatggttttgttttattattgggtttttaaaagattatttttatgatttttggttatttttttttttgttaaaattgttatttagttttatttattgttttttttaatttgaaatatagtttgttttttttgtgttttttttgttattttatttttagttttatgggggtgttgtagagtaaagggaaatttgttttttaaggtagtagtagaattagttagagtgggggttgggaaggaatttattttttttatattttagttttttttaattttttgtagtgagtttttagagggagaatttattagggttggtttatatataattaattttattattagggattttaaatttttttagtatattatttttgggattaagtgttagagtgttatatttttttattgttttttgttaaattaatgtgtttatattgaaagaaattgattagaatagaagattagttagaaagaaagagaaaattattattgaaaattttttaaagataggtatttattttttggtgagttttttttattttgaattgaatgaatggtgaggaaaattgtgtatttgttttttaatttttttttaatttttaggaaagtaattttgttaaatattatattagttgaattttttttagaatgttatttttttttttatttttgatttttttttagtatttagttggtattattatgtgggttttttttatttttgtagtgttgtgttataggattaaagaaagggttgatttgaatgtattttgatttttttaaattatttttaagaagttttaaagagtgattttatgtttggggttgtatgaataatttttgtagattttggggtattatattttaattagttttatgatttaatggttattgg

SEQ ID NO: 399 - DNA, 6456 bp, Artificial Sequence
  chemically treated genomic DNA (Homo sapiens)
ttagtaattattaaattatgggattagttgaaatgtagtgttttgaagtttgtaggaattatttatatgattttagatatggaattattttttagagttttttaaggatgatttaaaagaattagaatatgtttaagttagttttttttttaattttgtaatatggtattgtgggagtgagggaggtttatatagtgatgttaattggatattgaggagaggttaagaatgaaagaagaaatgatattttggaagaaatttaattggtataatatttgataaagttatttttttaggaattgaaaagagattgagaggtgggtgtataattttttttattatttatttagtttaaagtaaaagagatttattgaaaagtaagtgtttatttttagaaaatttttaataatgattttttttttttttttaattggttttttgttttggttaattttttttagtgtaaatatattgatttggtaaaaagtagtaggaaaatgtggtattttggtatttggttttagaaataatatgttgggaagatttgaggtttttggtgatgaggttaattatatatgaattagttttggtgggttttttttttaggggtttattgtagagaattaaagagggttgaggtatgagaagggtgaatttttttttagtttttattttggttggttttattattgttttagagagtagatttttttttgttttgtagtgtttttatggggttaagagtggagtggtaaagggaatataggagggataagttgtgttttaggttgaggggggtggtggatgaggttgaatggtagttttgataaagaaaaaagtgattaaaaattataaaaataattttttgagggtttaatagtaaggtagagttatataatttatattttaaattatatagatatgtttgagaaattttaaagtgttaattgtttataaaagaaaaaattatatatataaatatataaagaaaattttttttataaaattggggtgttattttgtatttagtgggatttattttaatttttttgaaaatgagaaggaaggggatttaaatgaaaaagtagatagtttgttttttggtagaataaatttgaatttgataatattatgtgtttttgggggtaaaatgtatattttaataatagtgataggattaggtttatgtatattttttaaaaattgtttataagataggtttttttgtagaggttgtagtaatttatttgttaataagtattaaaatatttagattttatagggatagatattttaatgtatattttttaagttttagtttttgtggaaaataattaatttttttgtatttttttgggttttaaaatttaaaatatagtttttaaaaatgtgtgtgtgttgtggggtaggggggtgtattgttaataatatttttggtgatagatggaattttttatgggattgttaatgaaagagattttttaaatattttagtaaatagtaattttttatagttttgattatttttttattataaatttaaattttgggttgagataggtagattattttagatatatttttattagaaattaataagtgatgagattttgtggaagttttaagaatttatttgtaatttaataagttgtttgaaggatttttatagttaaggtttagaatagtttgatttttgaaagttgtttttggtttaaatattttgggttaatttttgaggaatttgaaatattattttttttttatattttttttttaagagagagatataaaagaaataagagttttttttatttagggatgagtaggaggggaaaaaatttgaattaatatttaaataaggaaattagtagttttgaataaataaattaggatttataatgaaatgattttgtattgtaattgtttttaaaaagaaagtaatagagaaaaagagaaggaaagaattttttttttttttttattttttttttattttattttttaatttagttttaaagttaagaagattgtgttgtgtgtagtgtattgtagttgtggtagtttgttttaaatataggtagtatttgtgatattggtatggtaggtttttagaattttttttggttgattttttaaatatagattgaagagatttttttataatgattttgaaatgagttttgaaaataaaaattttaagattttaagagaaaataaaatataaataggtatttggtttatagaattttgtagaaaatatatatatattattttgttatttttatttttttttttatatatatgttttttgtaataagaaattttttaagagttaataataatagattaaatttattatttgttgttttggaaagaaataaattaaattaaaataaattttttgaatatttttttgaagtgtaggagagatatattttagtaaaagtttaagggggaaaaagaaaattgtattaaaggaaaaaaaaaaaaaaaaagtgggggttgggattgttatatatggttaaaaatttaagttttttttaatagtattagtattgaaataatatatttttaaaatgtttgagggattagatagggaaagaaaaggtatgtataaaaaaatttaattgatgttgattttgtgatttatgtaatattataaatttgtaaaaggtaaaaaattagaagtaaaaatttataaattattaaaatatagaaattaaaaattttaagttattatattagaaagaaaaaaatttagaataatagtaaaaatttttgttttaaataaaaataaagtaaatgaatttattgaaaattgtttggtaaatattttttttgtggtgtttaatattttagttggaaagagttgtgatgtttattttattttattttttttttatttgtttttttaattttattatatatataatatattttttttagtggtttaaattttttgtttttttttgtgtatttagtttgatttgttgagtttatgggtaagaaagaaggaattagttttagattttgggaaagtaaagtgtatttttttttttatgttattgaatagtaaattagtttttagaattttagaggttgagttttgttatagtgaaggtgttgatgttatagaggaggagtttatgtgatggtggtggagtaggttatattattgttttgggtttggggagggagagttatttttaggttttttgagttttgaattggaatttttaaatttgagatgttttgtttatgaggattttgaaatatgttggttagtgaaaaaattttgtggttttgagggtttttggttggttaggggtagtaaaaattttggagagttgatattaagtttttttttgttatgtagtagtggtaaagtttgaagtttaaattttgagaattgagttttgttgatttttagaattggggtttttagaagtggtgatgtaagaagtttttaggaaaggttggatattaggtgattattgttgttgttgttgttgttgttgttgttattgttgttgttgttgttgttgttgttggtgttgttgttgttgttgttgtttatgattattattttattttttaattttttttttttttgtttttgttaaatgttttggttttaagttttttatgtgtatttattgatataaatgtatatatttatttattttagttgttaggtgttaaaataaatgttgaagattagttttatgttttttttattataggatatagattgttatgtatttattattattattgttgtttttgagtgaattggttggtttggggaggtttttgttatttttttttgtgttgttttggtttttggaaaggaggtggaggagaggaaggaggggaattagggggtggttggagtagagaggatgagatagtgtttggggggtgatttgggttagtttgggggttgtttggttttagattgtggagaggatgtgtgtttgtgtttttgttttttttgttgttgtttgtgtatggtttgtgatttttttggatttgtgtggttgtgttttttttttttttttttgtttgtaaattgttttttttgttttgttgtttttggtttttgttttttttttttttttttttttttgtttttttttttttttttttttttgtttttttgggtaattttgggaggtaaaaagggaggttgtttgtttgtttgttttgttggtttttttttattggttttggttttttagattttttgtttttgagttgaattgagatttggaaggaaaaaatgtaagtgaattttttgggtttttgtttttgtttttttggttataaatttagatgagatgaagtattgtgtttattatttttttttagagttgtgatttttttaatgagagttgagtgttttggtgttttttgtttttgtgttttggggagtttgggggtggggatgttgaatattttgaaaattatttttttttggttgtagttgagggagttgggaatttttgtgtgttttttttgtttattttgaggagagagattgatggtgggatagggttttttggggtgggtgggaaaggggtgtgtattgtatttgtgatgttttttagtgtgtggggggatttagggaattttgataggatagtttgggagaatgagaaaggtggtgggatttttggttgttgtggtgtttgtattttgggtgttgtgtgattttgtgttggtttttaatggttgttgttttttttttttaaattttattttatttttttttatggtgtaagttttgtaaaaagggaattgtgggtttgagtgtagtggatgttaggttttagatttttgaggtttttattttgggtgaggagaaagatgaatagagttttagtttgtgttttttatgtgtaagatttaggaggagagaagggtattttgtggttgtggttgaggggatttggtgtgggaggagtgggtgtgggtgtgaaagggagatttttgtgagtgattttgtaaaaatagattgtgaggttggttggatttgtaatttgtggttttttttgagggagtaagaatgggggaaggtgtggtggtggtggtttggggagggagtgggtagagttggagttttagaaattggttgagttttgggggtgggtggggagaaagggtgggggggtagtaggagttaggggttattttgttgttggatgtagtgattgtggtaaatgttttgagaattgtgggttgtgttgtttttatgatgttgtgttattggaattttggtgaaaaatggaattagtgttgtaataatgagttttaaagtttttttatggaaaataaaaatataattaaattgattttttaaaaaaatgaaaaaagattttttgtgttgtgtttttttttatgatggttgtgttggtggttggggtttgggggtggggggttttgatagttgagtagataaatgattttaaattaggtgttgaaagttttaagttgttatagggtttttgattattttagagagttaatttttattttgtgttttttttttgttggtttttgttattttataatttgttaggatttaattttttatggattttttttttagtttatagtttttaggaggaaagttttgtaatgttttatttttttttttttttttttaaagtaaagtgagtgttagtagatgtgttttttatagtttggattttaaaaaaagtggggtaggagagagggaattagggaaagggttgtttagaaatatagtttgtggttttgagtgatgttattggttttttttatagagattgttagtttttttttttttttgtaaggtgtgtgtggttttaataaataatttaaaaaaaaaaagagggggtggtaagatttattaggagataggtatttattttgtttattatttattattaagagtttttggtattagaatagaattttgtaaatttgtagtttaagttgaagtttatttggttttagtttatatgttatttttggaggtagtaaatatgagtttaaagaagagagatgaaattatatttttgttttaaaatatatatttttttaaaaaagatgaaaagatatttgtttttgggggaggaggaaatggtgaataagtattaggagatgggtatttttttattttaatgattgtagttgagtttttaggttaaaatagaaatttgtagatggtaattttttttttatttttttgttttgtttgttattttaagtttataaatagaagtttttagtattttatttggaagattttttaatattagaggttgaagtattggttagttttaagggttgttgatagtgatagtaaggttagatgttgtttataaaaattgggtgatttgaaggagatagttagaaaaagtgggaattttttaattgttttttttttttttttagttttgaagggtttta

SEQ ID NO: 400 - DNA, 4001 bp, Artificial Sequence
  chemically treated genomic DNA (Homo sapiens)
tgtatttttttttttttttagtttttattaatttttgaaaaaaaatttttttaattagaaattttgtgagattgttttttttttagttttgattttaatgtttaagaaagatggtattattttttttgattatgaaaatttagatttttattattttttagaaatgtgatgagtgtgaagattattttgaatatttttaagttattagtttagttttttttttatggattatagtattgattttgttaattgataaaaataattagaaaatgttttaatgatatggtataaattatgaatattagaatttattagttttttttttataatttttttttattaatatgtaattgtaaaagaagaataagaagggaatgggggtaatggatttaggtttaaaatatatattttatttttgtttttttttatggttttttttggtatgtatgttgtatatttttaatatttttaagatattaaaaatttattaatttaagtatatttaatttagatttagttttagtttagatataatgtttgatttttaagagtttaaaatataattaaaaatgtaaatatttgaaattagtgttatattgagagttttttaaaatttaaatattaagatatatattttttttattaagatttgatttttaatatatattttttaaggtaattaaagggaatatttatttttgtttgaggaaaaaatattttgtaagttaaaatttttattaatatagtattttattatatgattttttttttttattttaaaataatggggtttaattttttgaagtgtagtttttttagtaataaaggtggataaatttgtttttttttgtaagtagatattttttaaaggtaagaaagggaagattttgttagtttagtttattatagttaatgttttttttattaagtgtttaattgttttgaaagttagatgttttagaaagttagatgttttatagttgttttggtggtaattattttaagatagtggtattaaaggttttgatttttagtttttttatttaaaaaatggggatattaattattttataataaagttttgatgatataatgagattataaataaaatattttgtgatgtttgatttattatttaattaaaatttttataatggatttatatttttggtttagttattatatattttgttaagtggtttttttttaagaaaaattggggatgggggggttaggggggtgggagagtagtagggagtaggaggtagggaaggaggaaaataagtaaaattagtatatatataagtttttttatttttgattgtttgtgttttttgtgttttttttttttaagtttttttaggtttatgttttgaatttttttttttataaatgaaatataatggatatgaattatagagaattttatggaagatattggagtttaagtttgtagattagttttttgtttataagtggaggtgattggaaaattaagttaaataagtgttggataattttaaatagttaaagaagttttaatgggatagggtttaggtttattaaaggaggtaatattagtaattgatgaaattatagtgatggttgattgattatgatttgaggtataagatgttaaatttaaggttattaattaatgtgtgtaagaagtggttttaattgatttgggtgatgttaattgtgtaattattggttgttgtgttattttaggtttaggaatagtttagtttgtaatagggagattttaattagggagaggaggagtggggtaaaggggttgggtgttttttaagttgttgtgtgggatgtggaagggatgaaagaggtgaggaagagtagtaaattaatttaatatatttatatttttgttgtgtttttaggattatgagaagtgggtagggggtgatttttggttttttttattttgtaaaggtttttaattgggttttttggttaattttttagttattgttattttgaaattttgtgtttttttgtattttttatgttattttttatttttttgttttgtttttttttagtgttgtttgattttggaattatagagaatatttaagaattttaggattagagttttttttggttttatataatatttaattggttggttgttggttaagagtttgttttattgtgtttatttagtataataggaattagaagaagatagttgttaattgagtggttgatggttttgttttttgagttggaggtattttgatttagttgttgggagtttggtatgttgagttgtttgagaatggtatattttgtagataaagaagtgttttgtgttttttgttttttggaattattttagtttttgtatttttttgttttttatgatttaagtaggtgtgattttttaggggtgtttttgtgtgtaaatgaatatttagataatatttgttattgagtttaatttgttttgtaagtattaggttattttatgtgagtgtttagtatgtgtggaaatttaatagataggtagaatagaatgtttgtagattatttgaataaataaattagtatttgtattagagttgtagattgtttatatgggtggtgatttattatttgttagtagtgttttgaagaagaaatatggggatatatatgtagttggttttaagttatatgagtggtaaggttgatatatattggttatatttttgattggtttttttattagttaaaagttttttatgatgttattttatgtatgggattttttatttaattttagtttttgttttttttttattttttattttttttttttgtgagttagtttttatttattttttttaaaggtaagtttaaatatttaaaaaattattttagaggatatgtttggttatttttaattttaatttgattattttatgtaggaaggttatttttattattagttataaatattttaaaatattgatggagatatatattaatttttagtagaatttttaaattgtttttgaaggtataagattggttttatatttaaatttatttttgtgttaggaaatttttgatttgattttagattgaatttgagtgttagaaagtaatgatgagatattgtaggttaaagttgataaattaggtagtatataaaaaagaaaataattttgaattgtgaaggtgagttaagttgtaatgttttgtaattagtttttttttttttttaatatattagtgattatagttttgtaatttgttttgaaaaataatgtaagaagagaaagagaaaatagtgtatgttggaaatattaaagttttttatgtagttaaaattttatatgtagttattatttttaagatatgttgagtagtttttattttaatatattttttgtatttggatgggagaattaattataataaatatagtttggtattaatagtatattaataattttgttagtatagattaaaagagtttttatgggaattattggttggtaaaggatttagaaaataaatatatttgtagagatttagtggaattattaataggtttttatagtttttggtgttttttaaaattaggtaattagtgaaatggtttatttaatgtgttatgtagtaaaggtagttgttttttttttgttagtgttgaaaatgaaattatatttttttttttgaaagtttataataaattatgatttttttttaaatgataaatgttttgagtagtgattttttattttgtattttaaatgtaatatgtgtagttgtgttttgtttttttgttttttaaatgttttagtgtttgaatatttatttgagtgatatttaattattatagttggttagggttgattgtagtgattgaaataggattttgatgtttttagttttgatttttattatttttaaatttatttggtttatattgtgtaattagtagatgtttatagattagttttttgttttaattgaagtatattgttata

SEQ ID NO: 401 - DNA, 4001 bp, Artificial Sequence
  chemically treated genomic DNA (Homo sapiens)
tgtaataatgtgttttaattaggataggaagttgatttgtaaatgtttattgattatataatgtaaattggatggatttgaaaatggtaaaaattaaaattaaaaatattaaggttttgttttagttattgtaattaattttgattaattgtgataattaaatattgtttaagtgaatgtttaaatattgaaatatttagaagataagaaagtaaaatatagttatatatattgtatttaggatgtagaatagaaggttattatttaaagtatttgttatttaaaagaaagttataatttattataagtttttagaaaaaagaatataattttatttttaatattagtaaaaaggaggtagttgtttttgttatatgatgtattaggtgggttattttattaattatttgattttagaaaatgttaaaggttatggaagtttattaatggttttgttgaatttttgtagatgtgtttgttttttaaattttttgttaattaataatttttatgaggatttttttagtttatattgataaaattattaatatgttgttgatgttagattgtgtttgttatagttgatttttttatttaagtataagaaatgtattgaaataaaaattgtttagtatattttaaaaatagtagttatatataaaattttagttatatgaaagattttaatatttttaatatatattgttttttttttttttttttgtattgttttttaaaatgagttgtaaaattatgattattaatgtgttaggaaagaaaaaaaattagttgtaaaatattataatttagtttatttttgtagtttaagattatttttttttttatgtattatttggtttattagttttaatttataatattttgttattgttttttgatatttaaatttagtttaaaattaaattaagaattttttaatataaaggtaagtttaggtataggattgattttatatttttaagggtagtttaaagattttgttaaaaattagtatgtatttttattaatattttgaaatatttataattggtggtaagaatagtttttttatatgggatagttaggttaagattagaaataattaagtgtattttttaagatagttttttaaatgtttaaatttatttttaagggaaataagtgggggttgatttatggaaagaggggatagaaggtagggaaagggtgaaggttagagttaagtgaagaattttgtatgtagagtgatattatagaggatttttggttggtgaaaagattagttgggaatatagttaatatatattaattttgttatttatataatttaaaattgattgtatatgtatttttgtattttttttttaaaatattattaataaataataaattattgtttatataagtaatttgtgattttaatatgggtgttaatttatttgtttaggtggtttataaatgttttgttttgtttgtttattaaatttttatatgtattaggtgtttatatgggataatttgatgtttataaagtggattaaatttagtggtaaatgttatttgggtatttgtttatatatggagatatttttaaaggattgtatttgtttgggttataagaaatagaaaaatgtaaaaattaaggtaattttaaaagatagaaaatgtagaatgtttttttatttgtagaatgtattgtttttggatggtttaatgtattaggtttttagtaattaagttaagatgtttttaatttgagagataggattgttagttatttagttagtagttatttttttttaatttttattgtattagatgagtgtaatgaggtgggtttttagttgataattaattaattgagtattgtatggaattggaagagattttggttttggaatttttgggtattttttatggttttagggttaagtggtgttaagagaaggtgggatagaggaatgggaaatgatgtgaggagtgtggaggggtgtgaggttttaagatggtggtagttgaggggttgattgagagatttagttgaaggtttttatgaagtgaaagaggttgggagttgttttttatttgttttttgtagttttgggagtatagtagaagtgtgagtgtattgaattgatttattatttttttttattttttttgttttttttatgttttgtgtagtggtttgggggatatttagtttttttgttttgttttttttttttttggttgaggtttttttgttgtggattgggttatttttgggtttggggtggtgtggtgattagtggttgtgtggttggtattgtttgggttggttggggttgttttttatgtatgttgattagtagttttaggtttgatgttttgtattttgagttatggttggttagttgttgttatggttttgttagttgttggtgttgttttttttggtgaatttggattttattttattgaagtttttttggttgtttagagttatttaatgtttatttggtttgattttttagttgtttttgtttgtagataaaaaattaatttgtagatttaagttttagtgttttttgtaaaattttttgtaatttgtatttgttgtgttttatttgtgggggaggagatttagaatatgagtttgaggaaatttgagaaaggaaagtataaaaaatgtaggtaattaaagatgggagagtttgtatatgtattgattttgtttgtttttttttttttttattttttattttttgttgtttttttatttttttaatttttttatttttagttttttttagaaggaaattatttgatagggtgtatggtagttaggttaggaatatggatttattataaagattttagttaagtagtgagttaaatattataggatattttatttgtaattttattgtattattagagttttgttataaagtaattgatgtttttattttttagatgaggaagttaaaaattagagtttttgatattgttgttttgaagtaattgttattagaatagttgtgaaatatttggttttttgaaatatttggtttttggggtagttggatatttggtgaaagagatattaattgtaataaattgggttgataaaatttttttttttttatttttaaaaagtgtttatttgtaaaaggaagtaaatttgtttgtttttattattggaaagattgtgttttaaaaaattaagttttattattttggaataagaggaagaagttatgtaatagggtattgtgttaataaaagttttagtttataaaatattttttttttaaataaaaataagtattttttttaattattttaagaaatatatattgggagttaggttttagtaagaaaaatatgtgttttaatatttaagttttggggagtttttagtatagtattaattttaaatatttgtatttttagttgtgttttgaatttttgagagttaagtattatatttgaattagaattgaatttgaattaaatatgtttaaattaatgagtttttagtgttttagaagtattgagaatgtatagtatatatgttaagaaaaattatggagagaggtaaaggtgaggtatgtgttttgagtttagatttattatttttattttttttttattttttttttataattatatgttaataaagggaggttatagaagaaggattaatgaattttgatgtttatggtttgtgttatattgttaaagtattttttagttgtttttattagttgataaagttagtgttgtgatttataagaaaaaagttaaattgatgatttgaggatatttaaagtggtttttatatttattatatttttgaagaatgatagagatttaaatttttatggttaagaaaggtgatgttattttttttggatattaaagttaaaattaaggaaagaatagttttatagaatttttaattaaaggaatttttttttagagattggtagggattagaaaaaggaagaaatata

SEQ ID NO: 402 - DNA, 4341 bp, Artificial Sequence
  chemically treated genomic DNA (Homo sapiens)
ttatggaagtttttagtgggggtttgtaagggattgtgagttgagttaaggagaatggaggtggggtgttaattgtttttaaagggaaatgttattttttatttatagttagttagttgagaatgggagtttttaaagggaggattatttatgggtttgtttgatttagttttttttaattttttttatttttgtagtaaaattttagttaaggaagataaagagatttttggagattaaaatagaatttttaatttgggttaatagtaggtttatgtttaaaatggttgttaattttaataaagaaagtagttagtttatatgttgtttgagatgggaaaaataaggtaggatataggttttagataaagatagtaaattatttaatttgtgataattttgaggaaattggtaatttagttatattgattagttattttttaagttggattagggttggaggttggggttttgaggtaggtgataagtttttgagataagtttgtatttgtaatttgttataatgttgggaggggttgtttaaaattttagtttatgtgttatttttaaatagtttatattaaatgttaattgtttttatgtgtgtttatgtgaagagattattaaataggttttgtgtgagtaatatggttgtgtattttatttgggtgtaggtgggttgagtttgaaaagagagttagtgaagggagataggggtggggttgttttataggatttgggaaggtaatggaaaattatagttaaagggggttgttttttggtgggtaggggtgaattttataaagtatatttttaagggtggggagaattataaataatttttttaagggtggggaagattataaagtatattgattagttagggtggggtaggaataaattataatggtggaatgttattagttaaggttgtttttattttttttgtggatttttagttattttaggttatttggatgtatatttgtaagttataggggatgtgatggtttggtttgggatgtgatggtttggtttgataattattatttatgttatgtttattattttaagttttattattattattttatttattttattttattttttttttatatatttgtttttattttggagaggttagatgagttagattttagggaggtttagaagtgggtaaggggaaatgggaaaggaggaagatggtatgggtgtgtttggttaggggtgggagtgttggatggagtttgggataagaggggttttgtagttattggtatataatgtttgggagtttttgttggtgttgggattattttagtgagttttgggagggaattgaagatttttaattattaatgtatttgtttttaaaattgatggggggaaggatatgtttaggtttaaggatatgtgtaggtttggatgattttgggttattagggagtttttggagtattttgatttttagatgggtttgatgaaatgagtatttgatttagtaggtttgggtttgggtttgagaatttgtgttttttgtgagtttttgtgaggtaagtgttgtaggtgtggggttaggagttaggttttgtttttgtgtttggagttgtttttagtatagggtttgtgagttttatttttttgtggtgtggggtggggttgggtgtggggtgaaagaggtgaagtgagagtggaggttgtattttagtattgtgtagggattggtgagtgttgtttttgggggtagtgtttagtaattgtgttaggagtgtggagaagggtattgggagagtggtgtttgtggtggagattagtgttttggagtatgggtatgatgggggtatttttttggttgttagtaattaataataataataattataattatagtaagggtgttgatgggtgggtttggagtatgtttgattttggtttttattaggttgtttaggtttttgatgatgtattagaaatatttttttaatttgtggtttttttgtaggagaggttgggaaggggtgggggatggggtttgggggaggtttttgagggattttagtaagtggggaagggtgttgggaaagttttagatttatggttgtgtgggttatgagtttatttgaatgttgattattgttttttgttgatttttattttttgggaatgtgtgaaagtaaatttaagttagattgtggaggttgttggggagggaaggtttaaggagtttttgttgattttgttgaataaagggggttttgagttgggttgagatggggtatgtgtgggaagatttttgtttgttgtttttttttattgttttagtggatgttatgtttggggtttttttggtgtgtggggttgatgtatttttggggtttattgtagttggttgggattgtggagtgggtgtggtggatgaagggaggtaggatagttttgggggtggtagaaggagtttgggtatagttgagatttgtgtttttattttattaatatttatagtaggtgttgttgagttgggtaattgggatggtttaagttatttggttaaattttaaattatgtttgttattgggaagtagagtttagtgatgttaattgtgtttttatttttattattggtgttagttttaaagggtttttaaaatggttgtgttattttttagttttggattgtagttgttggttaggaattttagtgttatggtggatatgttttttttgtgtttttgttgtttatttgtttatttagtttaggggttttggtaggtagtagtgtatttggtttaaagggtaagatgtttttttttttatttataataaatttaaatattagtagggtttggggggaaaaatgtttttagaagaaaaggtgaatgttagttttgtaagagttagttttaaaattagattgaattggtatatgtatatttatgtaataaatttgtatgttttgtatatgtattttagaatttaaaagtttataaaaaaagaaaaaattagattggattatgttgggaaagtgtagttttttttattttaggtattttttagaatgtaggtagtaggtggtttttattaggagttttgggagaggaagggggttgaattttattttttatttttgtttttttatggggtttgagttgaggaagttttattataaggagagaattttttgataattttggatgttatttttatttttattgtaggaattttgtggttatattgtgaggagattggttttgggttggaggttataggaagatttttattttttgaaatttggagtgaagaatgttgttatttagttattattttaaggtaaggtagaaatgaagtgggttgttgggttttttttttttttttttttttttttttgagataaggttttattttgttgtttaggttggagtgtagtggtgttattttagtttattgtaatttttgttttttaggtttaagtgattttggtgttttagttttttgagtagttgggattataggtatatattattatatttggttaatttgtatgtgtttagtagagatagtattttattatattggttaggttggttttaaatttttggttttaaatgatttatttgttttggttttttaaagtattgggattataggtatgagttattgtatttagttaggtttattttagttgttatgttaattaggttttttgtatttgtgtgttaatttttatttttttaaaaggttttagggtgatttagtaggtaatgagtgatttttaaatttaggatttattgtgagagatttatatatataattgagtagatatttatagtataatgattaaagggagtgatagggtaaggatttatagtggaggttttggaggttagtttattgatagttattttagggagtttagaagttttgttttagtgttgggtggtggagggaaatttgtttttttagggattttgtttttggttgtttagttgttaaagttaggaataagtttttagaaattttattgttaagattttgaaaatgttttagatattgttagttttttgttgtttttgtgattttttataggtgtgtgtgttattgggtttttatttattggggtttttggtggtattgggttatagtaagtgtttttttatttttttagtttattatatatatgtttattattttgaagaaaaatttttttattatgagtgaaagtgagaaatatgtatgtttattgtttttaaagaaagaaatttaatatgggtttaatgttatttagtgagtgtttttattttgagatattagggttataagttattattatatattatgggt

SEQ ID NO: 403 - DNA, 4341 bp, Artificial Sequence
  chemically treated genomic DNA (Homo sapiens)
gtttatgatatataataatgatttgtgattttaatgttttaaaatggaggtatttattaggtagtattaagtttatattaagtttttttttttagaaataataaatatatgtgttttttatttttgtttatagtaaaggggtttttttttaaagtggtaagtatgtgtgtggtagattaaggggatgagggaatatttgttgtggtttaatgttattagagattttagtgaataaggatttagtggtatgtatatttgtggaggattgtaaaagtgataagggattagtaatgtttgaagtgtttttggaattttggtagtgagatttttgaaagtttatttttgattttggtagttgggtagttgaggatgaggtttttggaggaatagatttttttttattatttagtattagagtgggatttttggattttttggagtggttgttagtgggttggtttttagagtttttattgtgggtttttattttattattttttttaattattgtattgtgaatgtttgtttaattgtgtgtgtgaattttttataataaattttgaatttgagaattatttattgtttgttgggttattttgaaattttttgggaaagtgaaagttagtgtataggtgtaggaaatttggttaatataataattaaaatgaatttgattgggtgtagtggtttgtgtttgtaattttagtattttgggaagttaaggtgggtggattatttgaggttaggagtttgaaattagtttggttaatatggtgaaatgttgtttttattaaatatatataaattagttaggtgtggtgatgtgtgtttgtaattttagttatttaggagattgaggtattagaattgtttgaatttgggaggtgggggttgtagtgagttgagatggtgttattgtattttagtttgggtgatagagtgagattttgttttaaaaaaaagaaagaaagaaaagaaagaatttaatggtttattttatttttgttttattttggaatggtggttggatggtggtgttttttattttagattttagggagtgggagtttttttgtagtttttgatttagaattgatttttttgtagtgtggttatagaatttttgtagtgagggtaaaggtggtatttagggttgttagggggttttttttttgtggtgaagtttttttagtttagattttatagaggagtagggatgggaggtaggatttagtttttttttttttttaaaatttttaataaggattatttattgtttatgttttaggaaatgtttaagatggaagaggttatatttttttaatataatttagtttagttttttttttttttataagtttttaagttttggggtatatgtgtagaatgtgtaggtttgttatataggtatatatgtgttaatttagtttagttttaaaattaatttttgtaggattgatatttatttttttttttgaaagtgtttttttttttaaattttgttggtatttaaatttgttatgaataaaagagagaatattttgttttttagattaaatgtattgttatttattaaagtttttgagttgggtgagtaggtgggtggtaagggtgtgagggaggtgtgtttattgtgatattgggatttttggttggtaattgtggtttaaggttgaaagatgatatagttattttaggagttttttgggattgatattggtggtggaggtagaggtgtggttagtattattggattttattttttagtaataaatgtgatttaaaatttaattaaataatttgggttattttaattgtttagtttggtagtatttgttgtgagtgttggtgggatgggagtgtaggttttagttgtgtttgggttttttttgttatttttgggattgttttgtttttttttgtttattgtatttattttatgattttggttaattatgatggattttgagggtgtgttagttttatgtgttggggaggttttaggtatggtatttattggggtggtgggggggaatagtgggtaggggtttttttgtgtatgttttattttggtttagtttggaattttttttatttagtaggattggtgagaattttttgaattttttttttttagtgatttttgtagtttgatttgggtttgtttttgtgtgtttttaggaaatagaagttgatggaaagtagtggttggtgtttgggtgggtttgtggtttgtgtagttgtggatttgaaatttttttggtgtttttttttgtttattagagttttttggagattttttttgagttttgttttttatttttttttaattttttttgtaggaaggttgtgggttagggggatgtttttgatgtgttattaggagtttgggtagtttggtgggaattagaattaggtgtgttttgagtttgtttattagtgtttttgttatgattatgattattattattgttagttattagtagttgagaaggtgtttttgttgtgtttgtgttttggagtgttagtttttgttatgaatgttgtttttttaatgtttttttttgtgtttttagtgtggttattgggtgttgtttttagaagtgatatttattggtttttgtgtagtgttggagtgtggtttttgtttttgttttgttttttttattttgtgtttagttttgttttgtgttgtgaagaaatgaaatttatagattttgtgttgagggtggttttgggtgtagaaatgaaatttagtttttggttttgtatttgtagtatttgttttgtgggaatttgtgggagatgtaggtttttgggtttgaatttaggtttgttgaattagatgtttgttttattaggtttgtttgaggattaaggtgttttggaggttttttaatggtttggagttatttaagtttgtatgtatttttgaatttaggtatgtttttttttttgttggttttgaaaatagatgtattggtaattgggggtttttagtttttttttagggtttattgggatgattttagtattagtagggatttttaggtattgtgtgttaatggttgtagagttttttttgttttgaattttgtttagtatttttatttttaattaggtatatttatattatttttttttttttttgtttttttttgtttatttttaggtttttttggagtttggtttatttggtttttttagggtggaaatgggtgtgtggaaggaaaataaaataaaataaataaaatagtaataataaagtttaaaataataaatataatataggtaatagttgttaggttaggttattgtattttaggttaggttattgtattttttgtgatttgtaggtatatatttagatggtttaaagtaattgaagatttataaaagaagtaaaaatagttttaattgatgatattttattattgtgatttgtttttgttttattttaattgattaatgtattttgtaattttttttatttttaagaaggttatttgtaattttttttatttttgagaatgtattttgtgagatttatttttgtttattagagaataattttttttgattgtaattttttattatttttttaaattttataaaatggttttatttttatttttttttgttgattttttttttggatttagtttgtttgtatttaggtgaaatatatagttatgttgtttatataaagtttgtttggtggtttttttatatggatgtatatgaaaatagttaatatttagtataagttatttagaagtaatatataggttaaaattttaagtagttttttttagtattgtaataagttgtagatgtaagtttattttaaaagtttattatttgttttgggattttagtttttaattttagtttagtttggaggatgattagttaatataattgaattgttagtttttttagaattgttatgggttaagtaatttattgtttttgtttgaaatttgtattttattttgttttttttattttaaatgatatataagttagttgttttttttgttggggttggtagttattttgggtatgagtttgttgttggtttgaattaaaagttttgttttggtttttaaaggtttttttgttttttttggttagagttttattgtaaaggtgaaaggggttggggagggttgagttaagtagatttatgggtggttttttttttgggagtttttatttttggttaattggttgtgagtgggagatggtatttttttttgggagtggttggtattttatttttattttttttagtttagtttatagttttttataagtttttgttaaagatttttatga

SEQ ID NO: 404 - DNA, 4433 bp, Artificial Sequence
  chemically treated genomic DNA (Homo sapiens)
ggtagaattggtgtttatagtttttggggtttaattttattaggtaggaggagttgagttggttttgtaattgaagtttaaggttagtgatggtagtgaggggtagagtttagggtaggggaaattagagtttttaggatgtggttagtagagttttgtttttgttgtagtgttgggtgggggtttggttgttatggtttggtttttatttaagatggttgttgaggaggtttgtagagaggtattaggatagtaatggggtagtgttatttttgtggttttttgagtggaaggaaaggagttttttaggttaggtattgtttttttgggtaggagtgaagtaggggggatgtttgttttttttttgatttattttattttttggagttttggtagtgaagtggaggtggagataggtggtgttagggtgtttttttgttaggttgtaggttttgtggggtaataggatattggtttttggtaggtgggtgtggggtttttgggtttgatggggagaggttggggttggtggtggtggatggatgttggtttgggagatagagtttgttgtttttggaaattggatttgttttgtttgggtgttgtggggagtgtgtgggatgtggtggatggggttgttgttttggatgtttatgtgtgtggtttttttataggatttttatttgtttaggagtttgtatttttggtgttgtttgttttttgtgttttgtagtttgggttttagatggaaggttttggggttaagggtggttggagtagggaggttttgggggtttttgtttttggaggaggttggttttgggttagtagggaggttttgggtatttggagttttggtttagttttagattttatgtgtttttggttagagagtttgttttaaggttgtttatttttgttttaagggttgggtgttataggggtttatgatgttggtgaggttggggttgatagtttttgagataatagttttgttgttgatttggggtttatttggtttttggagtaagtaaagttggttgtagttggttatagttgtgtgtttttttggagttgtgagttttgtttgtgttttgtttttttgtttgtagtttttggtttggggtttttatttgaagttttgattttttttttttttttagattttttgtttttggaggttatttaggatttttttgtgggtgaaaattttagagtggtgttagttttaagtttagttttagtttaagttttaattttagttttagttttagttttagttttagttttggttttattttttagtttagtattaattttagttattattttaattttattttttattttagttttagttttagttttaattttagttttaattttaattttagttttagttttaagtttagttgtagttgtaattttagttttagttttagttttagttttaatttttatatttttatttttagttttaattttagttttaattttagttttaagtttagttttaattttagttttaattttagttgtatttttagttttaattttagttttaattttagttttaagtttagttttaattttagttttaattttagttgtattttttgttttagtttttattttagttttaattttaattttagttgtattttttgttttagttgatgggttaaagttttaggagagtgtggttttttttaggtgttattaggaggggtaggttttagttagttggggaaattttattgttatggtttttagaagttattttttttttaggtaagataggttttaagggagtgttttgagggtggtttttgggagttttgtgggttttagtatttttatatattttgaggatagatatggttttttttttttagtggggatagttatagggataggtatagggggtttggttgaggttggaggttagttatagttaagaagttttgagattaatggattgtttagtttagatttttttttaggtttaagaggagagggaattagggagaaaagtttagatttgttgttttaagttgtgatgtttaggggttttgtatagttttttgtgtagaggttgtttggttttgtggtttttttttttgtgaggtgtttatagttggtattttagttatggaaatgtagtaggtgtgaaattgttttgagtttggagtaggaggttaggttggttgttttgggggatttttaaggggaggtgttgggggaggggggtagttttgttggttgtagtggggtgtttatggaaaagtaggaggaggtttggaagtttatggtgtttttgtagaggtttgggggttggggggtggtggaggggttttggaagtttagtttttgggttttggagtttgttatggtggtagttttgtggtggtggttggatttgggtagttgtttggatgtgttggtttttgtttagtagtatggagagtttggtttggtgtaggagatttatgtgttgatgagtgataatttgttgtgagtgttgggagatttgtgtttttattgttggttgagtgtggttgattgtgagtgtatttttagtttgtggattggttggggttgggtggtgttgggtgtttttgtattgtttagtttttattaggggggttgtttagggttttttaggggtttttgtggtgaggagttttttgtggtggtttttgtgtttttgtttttatttgtgtatttgtatgtgtttaatttttgggagaatatttggtggtttttgatttaggtgtttgaggaggttttgttttggggttgtggtttttgtattatgtataattatttgtttttggtggggggtatttgtggttttggtgttaaggttgtttgttttaatgaggttttttgttataattttttgattaatatttggagttaggtttggtttatgtagtaggtttgagtttagtttaagttggtggttttggatgggttgttttatgttattggtggtgaatgtttgtatagtatggagtgttatgatttgtgaatagatgtttggattttatgtgtgttattttttgtaggtattttttttgtggtttatgaggttgtggtttgttgtggggatatttatgttattgggggttattttttttattgtttgtttaggtatagttttgtgaaggatgtttgggatgagtgtttatatagtgttagttattggtgttttagtgatattgtggtattggggggttttttgtattgttttgatttgttgtggggtgtgggtgttgttgtgatgtgttataatatagtgattggtttttggagtagggttgtttttttgtttttgtttgtttttgttttattgtattgtattattttgggtaatattatttattgttttaatttttaggttattgttatttttatggtttttggggggattgtttagttttaggttaaggagttgtagtttttttttttggggagtattggggtttttagtttatttattttgattttgttttttgaggattggttgtagattttattttgagtggtaggtagagaattaaagttgttttgttgttttttagggagatttttttgggatgggtttgagaggttggggtttagggaaggggttgggattggaattttttgtttttgtttttggataattttttttttttgttttaaaggttgttgattattttgaagtttagatttttttagtttttttttgttttttattttatatttagattgttttttgatttaattttgtatttatttatagatttttttagtttgttgatatttttttgtttgtgggattttttattttttagagttagggattgatgtgtttttatagataaggatttggtttgttggagttttgttgagttgagagaggagggggtagaaaatatttatattttttatgttttgttagtaggatagggagtaaaaatgtttttaggtaatgtttttgtttttgggattttttgtttgttttaaggtttttttaggtattaattttgtagttatttgggtttgtttggtattgtggatttttaagggtttagaatttttgtttttgaaattggtttgttggtgtagttttgttgtttgtagtttttgtttatatttttagtttatattaggttaggtttattttgggtttattattttttgtagttttgtggggtttttttagtttttttagaagtttattttattttttgttaatttttgatttttaaatgaggtttgagtgttattttagttttgtttttttttagttgtgtagatttggatgagatatttgatttttttttttttttgtttataaaatgtggatagtggatgtttgttatttaagagagttgtgggagataagattatagttatgagtattttgtatggtgtttaggatg

SEQ ID NO: 405 - DNA, 4433 bp, Artificial Sequence
  chemically treated genomic DNA (Homo sapiens)
tattttggatattgtgtgaggtgtttatagttgtgattttgttttttataatttttttgggtgatagatgtttattgtttatattttatagataaggagaaagggaagttaaatgttttgtttaagtttatatagttaaaaaggggtagaattagggtgatgtttaggttttatttagagattgggggttggtgagaagtggggtgggtttttggaggggttgggagagttttataaggttgtagagggtggtgagtttggagtgggtttggtttggtgtgggttgggggtatgggtaggagttgtagatagtagggttgtattagtggattagttttagaggtaagggttttaggtttttgagaatttatagtgttaaatagatttagatagttatggggttggtatttggggaggttttaggataggtagaaagttttagaggtgagggtgttgtttggggatgtttttgttttttgttttgttgatagagtataggaagtgtgaatgttttttattttttttttttttggtttagtagagttttagtgagttaagtttttgtttgtggagatgtattagtttttggttttagggaatagggagttttatagataggggggtgttagtaagttgagagggtttgtaagtaggtatggaattgagttaggaaatagtttgggtgtggagtgaggggtagaaagaggttgagggagtttgggttttaaaataattgataatttttaaagtagaaggggaaagttgtttagaaataagagtaggaagttttgattttagttttttttttgagttttggttttttaggtttattttaggagggtttttttggagagtagtgaagtagttttggttttttgtttgttatttagagtgaggtttgtagttggtttttagggggtagagttaggatgaatggattgaggattttggtgttttttaaggggaagggttgtagttttttggtttggaattgggtagtttttttagagattgtgaaggtggtagtgatttgggggttgaggtagtaaatggtgttgtttagggtggtgtagtgtagtggggtgggggtgggtaggggtagggaggtagttttgttttaggagttggttattgtgttgtagtgtattatggtggtgtttatgttttgtagtaggttgaagtggtataggaagttttttagtgttatgatgttgttggaatgttggtggttggtattgtatgggtatttgttttaagtattttttatggggttgtatttgagtaggtggtagaagaggtgatttttggtgatgtagatgtttttatggtaggttatagttttgtgggttatagggaaggtgtttgtggggagtggtgtgtgtggggtttaggtgtttgtttgtgggttgtagtattttatgttgtataggtatttgttattgatggtatagagtagtttgtttagggttattagtttgagttgggtttgggtttgttgtatgggttgaatttggttttagatgttggttagagggttgtagtagaagattttgttggagtagatggttttggtattggagttatggatgttttttgttagaaataggtagttgtgtatggtgtagagattgtagttttgaagtggggtttttttgggtatttgggttaggggttgttaggtgtttttttgggggttgaatatatgtaggtgtgtaggtagaggtagggatataggggttgttgtaggaggttttttgttatgagggtttttggggagttttgagtggtttttttggtagaggttgggtagtatgaggatgtttagtattgtttggttttggttggtttgtaggttgaggatgtgtttgtggttggttgtgtttagttggtggtagaggtatgggttttttagtatttgtagtaggttgttgtttattagtgtgtaggttttttgtgttaggttgggttttttgtgttgttgggtaaaggttagtatgtttaggtaattgtttaggtttagttgttgttgtagggttgttgttgtggtgggttttagggtttgggagttgggtttttggggtttttttattattttttaatttttgggtttttgtagaaatattatgagtttttgggtttttttttgtttttttgtgagtgttttgttgtggttggtagggttgttttttttttttggtgtttttttttgagggttttttgaggtggttggtttgattttttgttttgagtttggggtgattttgtatttgttgtgtttttgtagttggggtattggttgtgagtgttttgtagaggaggaggttgtggggttaggtggtttttgtgtggggggttgtgtggggtttttgggtattgtggtttggggtagtgggtttagatttttttttttggttttttttttttttaggtttgggggagggtttgggttgggtgatttgttggttttggagttttttggttgtggttgatttttagttttaattaggttttttgtatttgtttttatgattgtttttattgaagaagaggggttgtgtttgtttttagagtgtgtggaagtgttgggatttatggggtttttgggaattgtttttgggatatttttttggggtttgttttgtttggggaaggggtggtttttaagaattatggtaataaggtttttttagttggttgagatttgttttttttggtagtgtttggggagagttatatttttttgaggttttgatttgttagttggggtaggggatgtggttggggttggggttggggttgaggtgggggttggggtaggggatgtggttggggttggggttggagttggagttgggtttagggttggggttgggattggggttagggttggggatgtggttggggttagggttggagttggagttgggtttagggttggggttgggattggggttagggttggggatgggggtgtgagggttgggattgggattggggttggggttggagttgtggttgtagttggatttggggttggggttggggttgaagttggagttgaggttggagttggggttggggttgaggtgggggatgaggttgaggtggtggttgaggttggtgttgagttgggggatgaagttagggttggggttaggattgaggttggagttgaagttaagatttgggttgaggttgaatttggggttggtgttgttttgagatttttgtttatggaaggattttgggtaatttttaggggtaaaaagtttgaaggagaggggagagttagggttttaggtgggaattttgggttgggagttgtgggtggggaggtggagtgtgggtgaggtttatggttttgggagggtgtgtggttgtggttggttgtagttggttttgtttgttttgggggttgggtgggttttaggttagtggtaggattgttattttgggagttgttagttttggttttgttggtattgtaggtttttgtggtatttggtttttgggatgagagtgggtgattttgaggtggattttttagttaggggtgtgtggagtttggggttgggttaaagttttgggtgtttgggatttttttgttgatttagggttagttttttttgggggtagggatttttgaggtttttttgttttagttatttttggttttagagttttttgtttgagatttaggttgtagggtgtggggagtgggtagtgttgggagtgtgggtttttgggtgagtgggggttttgtggggaggttgtgtgtgtgggtgtttagggtggtggttttgtttattgtgttttatatgttttttgtggtgtttaggtggagtgggtttagtttttgggggtggtgggttttgttttttgagttagtgtttatttgttgttgttggttttggtttttttttattgagtttgagggttttgtgtttgtttgttaggggttagtgttttgttgttttgtggggtttgtggtttggtgagaggatgttttgatattatttgtttttgtttttgttttgttgttagggttttgaggagtgaagtggattaggaggggggtggatattttttttgttttgtttttgtttaggagggtagtgtttggtttgggaggtttttttttttttgtttggggggttgtgggggtggtattgttttgttgttgttttaatgtttttttgtgggtttttttgatagttgttttgagtggaagttgggttatggtggttaggtttttgtttggtgttgtagtagggatagggttttgttggttgtgttttgggggttttggttttttttgttttgggttttgttttttgttgttattattgattttagattttggttgtagggttagtttagttttttttgtttgatgaggttgagttttgagggttgtggatattggttttgtt

SEQ ID NO: 406 - DNA, 4494 bp, Artificial Sequence
  chemically treated genomic DNA (Homo sapiens)
attataaattagtattattataaaggtaagatgattgtgattaggttaaatttttaatagagggaaataaaatttaagaggaagttagatttaaaaataaataaataaataaatattagggtagtgaaatattatatagattagggtttgttaaatttatatttttattaatatattagttaaaattattaatttagataataattatgttttttttgatagttaaggttttattattattgtttttatttattttttttttatagttatttgtagtagatttattttttaagttttataaaagatagttaatttgtaattatatttttttagtggatatagagagaattagataaattatttttaaattttagtagattgaattatttatttttttattaatattttgtaaaatggtataatgtgaattttatttttattttttaaaggagttaataatagttattgaaaaggttttaaaagatggtagaaagagtatattaatgtaattaaatagattaaaaattaaatttgaatttgtttatatgttttttttttttatatagaaagaaatattgtttaataaagttatatatttaagttttgataaaagttttaaaaatatggttattatatgtttttaattttttaaatgtatggtttttaatttgtagtaagattatttgggaaaattggaataattttataaataaatgtaagtaagttatgagagaaattagaatttttttagttaagtgtatttttttaaaatatggaaaatgaaattttttaatttttaaaataatttgttttaattagttttaaggtgatttttgagttatttgtgggtaaaaattagaagagaaaaaagtttaatgattttgtaaattagaaattaaaaaattaatggtgtgatagtttgtatagttttagtggaattataggaaaatatttgtttggaaattgtttttttttttttggaaaattattaggaggttgggggaaaagaggggaaaaatgggtaaggaaggttgtaaatgttaagatgttaaataggaatttaattgaagtttgaagtgaaatatagttttttttggtttaattgttatgtaaataatttttaagtatttttagatgtaaagaaaaatagttattgtgtataggtgttagttgaatgtttgagagttggatgaatggggaagatttgttatatatttagtggtgggtggattttattaggttgtagtttttatatagtttttttttgttgtattgtagaggtgttattttttttgttttaatttttatttaatttgatttttttatttgtattttaaaaaaaagattttttggattttttttagtattttgtgtttttaggggaattaaattagagtttttagagttgttagggaagaggttgtgttttaattagataaatgtttttttggatgtataggatagagtttgtgtttttttattatttgttattgttttttttagatgtatattttattttttgttttattttttttttgttaaggattttatagtttagtatagaattaagttttggaggtgatttgagggtgggaagtagaggggttttgaggttttgttagaagttttggtagtgtttttgtttttttttaggtggatgtgtagttttgggaagggagttgggtgggagttttggtggtgtattgagattaatgtggtttggtttatggtgagggtggggtgttgtggtttttgtttttgtggattttttgttttttagatagagtttagggtgtgagtgaatttttgggatgtttagatttggggaaggtgtggggtggttatgggtttttgattttttttattttttgtaagttatataaaagggagatgtggatatgtataaagtttgtttgtggaaggtggtgtgtgattttgatgttggtttgggttagggttgtatttaggttgttgttgttagtagttgtgaaaagaggttggagtaaggaagggggatgggggtgagagaggaaggtgaaatgaggtggagaatgtagggaaaagtgaggggtttttagttttttgggttgttttgattttttttttttttttttagggtttaagagaaaggaaagggtaatgatttaagagtgaaggattggttttagggatgttgtgtttttggttttttttatgtgttttttttttttttttttttgtttgaatgttttttgttttttttgatttttgtttttaaggtagggattaagttggggtttgggtttagggttgttttttattttttttgttttgggttggtgtggaattagggagattagtgttttgtttgtttttttttagtgggttggagtgtgattttttggggtagggttgggttgaaagtggggatgtgttggatgtttgtaagtgggggtggagaggagaggggttttattgatggatttttggtttttttgtattaaagatttgggttaaggttttggggggtattgtgtttttattgtgtagtttttttttgttttttgaggtgtggtatttatttttagtgtttgagttgtttaggtggttagtaggagtagtgttaaattgggtagtattgtgattttgtgtggggtattgagtgtgttgttgtgtgagtgggatttgttgtgtttttgttttgtttgtgttgttattgttgttgttttttggggtttttgtgtatgtttttttgtgtgtttttgtttattgttgttgaggaaattgatggagtttgagtgtggtggtggggtttagagttaggtgagttagttgatttggtttattttgtttggtatttgagagagatttttagtggtgttgttggggaattgtgtttgtttgtgttgggaggggtttttgtgttttgtgtttataggtgtatgtgtttttggtgttgtttgtattttatgtgttttttttgttttttggttgatggtttatttgggttttgtgaatagtgggagggagagtttggggttaggagagggatggtgtaggattagggaaaggtgagttttaggatgttgaggttttagaaaagttgagagtgtttttgtttgtttttgtgagtttgaattatttgattttgtaggttttttgggggtgttgtataaaggattgttgttagggtgtgtttttatttgtattttgtttttttttttggtttggagaggtggggtaggtgtttttggaagagaatgagaatgagtgaagtttaaaggaaataggattttttttgtttgttgagatagtaaaattttattttttaatttttaatgttaaaagtaggtatgagtaatttggaatttttatttttagaatgaattaaaggagtaaggtgtaggatttggtaaagaagtggttaatttatttatttttttttgaaagtagggttttgggtttgggttttgttttttttttatatttttgtttgtttttggttttgttttgttaaagggggtggttagtgtggattttgtggggtggggggtttttttttgttgttaagtagggatgtaatatttatttgagttggggaagaaggaaaaattaggagagattatttgtatttgatttttgtaaatgaggatttttgattttaaatgttgtttttgttttttattgtgtttgttttgaattatagaaatgaattttttgttatgttatttttttttggattaaatataaattgtttattgtttagttagtgtttagatagtttagaatgttttagaattgtttagatatattttttgtttttgatttgaagtagtatttagttattaagttatagtttattttatatagggtttggagtgaaggattgaagttagggagtgttttggtttttttgagggttgtattgtagtttgtttttttttttttgtttattgtgttgataagggtgtttaggtttgggaaggatggtttagttagtggggtatagattttttttttgggaagttatttttgtattagtttttttaaatgttgttttgtgtgtttttttttgtattaggtatttagttttgatttttggattatttttgtttttgaatgttttttggatgtttttaataaataaggataaatatttattgttatgtagtatttgtttatatgttttatgttatttattttttataaaagttaaagaggttgttattattatttttatttatatattaggaaaatgaagttaatgaatttttaaatttaatagtaagtaagtgatatgaagttgggatagtagggaaaagtttaaagtgataggataaatttagttgtttattttttgtattatatttatttattgtaattttgtatttgttttgggtttgtatgagtaaataaggtaaaaaagaaggtatttgaatgtaaagagaaatgtggtttaaagttataaattttgtagagtttattgtaaaatgtaaatgtgagattttttgttat

SEQ ID NO: 407 - DNA, 4494 bp, Artificial Sequence
  chemically treated genomic DNA (Homo sapiens)
gtaataaagggttttatgtttgtattttgtagtggattttgtaagatttgtagttttggattatgtttttttttgtatttagatatttttttttttgttttatttgtttatgtagatttggaataaatatggaattgtggtgggtaaatgtggtgtagaaagtgaataattgggtttgttttgttattttaggtttttttttgttgttttagttttatgttatttatttgttattagatttgggagtttattagttttatttttttgatgtataaataggaataatagtaatagtttttttggtttttgtaggaagtaaatgatatgaagtgtataaataaatattgtatgataataaatatttgtttttatttgttgaggatatttaaaggatatttaggggtaaaagtaatttaagagttaagattgaatgtttagtgtgggaaaagatatataagataatatttaggggagttggtatagaaatgattttttaggaaggaagtttgtattttgttggttgagttattttttttgggtttaggtatttttgttagtgtaatgagtaagggagagaaggtaggttgtagtgtagtttttagaagggttagagtattttttggttttagttttttgttttaagttttgtgtggagtgggttgtggtttggtaattaaatgttattttaggttaagagtaggggatatatttgggtagttttagagtattttaaattatttggatattaattggatagtggatggtttgtgtttaatttaggagaaagtggtatggtagaaggtttatttttataatttaggatagatataatgaagaataagggtagtgtttgaggttagaagtttttatttatgggggttgaatatgaatgattttttttaattttttttttttttttaatttagatggatgttatatttttgtttaataataaaaaaagattttttgttttgtaaaatttatattgattattttttttaataaaataaaattaaaaataaataaaaatataagaaagaaataaaatttaagtttagaattttgtttttaagaagaagtaaatgggttggttgtttttttgttaggttttgtgttttgtttttttggtttgttttaaagatagaaattttaggttgtttgtgtttgtttttgatgttgggggttaaaaaatgaggttttgttgttttaataagtaaagaaaattttattttttttaagttttatttgtttttatttttttttagaaatgtttgttttatttttttaaattgagagaaaaaatgaaatgtggataaaaatgtattttagtagtagttttttatatgatatttttgggaggtttgtggggttggatgatttaagtttatggggatgagtaggagtgtttttgatttttttagagttttagtgttttaggatttatttttttttgattttgtattgttttttttttggttttagatttttttttttattgtttatgaagtttaggtgggttgttggttggggagtggagggggtgtgtggggtgtaggtggtgttaagggtgtgtgtatttgtgggtgtggggtgtgagggttttttttggtgtgagtgggtgtagttttttggtggtgttgttaggggttttttttgggtgttgagtggggtgggttggattagttgatttgtttggttttgagttttgttgttgtgtttgggttttgttagtttttttggtagtggtaggtgagagtatgtggaggagtgtgtgtgggggttttgggagatggtggtggtggtggtgtgggtagagtaaggatgtggtggattttatttgtatagtagtgtatttggtgttttgtgtagggttgtgatgttgtttggtttggtattgtttttgttggttgtttggatggtttgggtgttggaggtgggtgttgtgttttggaaggtggggggaggttgtatggtggggatgtgatattttttaagattttaatttaagtttttaatgtagagaagttgggggtttgttaatgggattttttttttttttgtttttgtttgtggatgtttagtgtatttttgtttttggtttagttttgttttagggagttgtgttttggtttgttgagagggagtgggtgaggtgttggtttttttggttttgtgttagtttggggtgagaagggtagggggtgattttgagtttagattttgatttagtttttgttttggaagtgggggttgggggaggtgagagatatttagataggggggaagggggaaggagtatgtggggaaaattgaaaatgtagtgtttttaaagttagttttttgtttttgaattgttgttttttttttttttttgggttttggggaggaggaggaggagttgggatagtttaggaagttaggagttttttgtttttttttgtgttttttgttttgttttattttttttttttatttttattttttttttttgttttaatttttttttgtggttgttggtggtggtagtttgggtgtgattttagtttgagttggtgttggggttgtgtattgttttttataggtaaattttgtgtatgtttgtgttttttttttgtgtaatttgtgagaaatgggaggggttggagatttatagttattttgtgttttttttaagtttggatgttttgggagtttgtttgtattttaagttttgtttgagaggtagaaggtttgtgggaataaaagttgtgatattttgtttttgttgtgggttgagttgtgttagttttagtgtgttattgaggtttttgtttggttttttttttggggttgtgtgtttgtttgggagggggtagagatgttgttggggtttttggtggagttttggggtttttttgttttttatttttggattatttttgaggtttaattttgtgttgggttgtaaagtttttggtggggaggaaataaggtggagagtgggatgtgtgtttggaaagggtagtggtggatggtggggaggtatgggttttgttttgtgtatttaaggaggtgtttgtttgattaaggtgtggttttttttttggtagttttggggattttggtttagtttttttgggggtataggatgttggggagggtttgaagggttttttttttagggtgtagataaaaggattgaattgagtgaagattaagatggagaagatggtgtttttgtagtgtagtaaagaaaagttgtgtggaggttgtagtttagtgaaatttatttattattaggtgtataataagttttttttatttatttaatttttgaatatttagttaatgtttgtgtataatgattgtttttttttatatttgaagatgtttagaagttgtttgtatgatagttgggttagaggaggttgtattttattttggattttggttgggtttttgtttggtattttaatatttgtaattttttttatttgttttttttttttttttttttagttttttagtaattttttaaaagaaaaaaagtaatttttgggtagatgtttttttgtaattttattgaggttgtatagattattatattattagttttttagtttttaatttgtaaggttattgaattttttttttttttgatttttatttataagtggtttaggaattattttagggttagttaagataggttgttttaagagttaaagaattttgttttttatgttttaaaaaaatgtatttaattaagagaattttgattttttttatgatttatttatatttatttgtagaattattttagtttttttgaatggttttattatagattaaaaattatatatttaaggaattaaaagtatatgataattgtatttttgaagtttttgttaaaatttaaatatgtaattttgttgagtaatatttttttttgtataaaaagaggaagtatgtaggtagatttgaatttagtttttggtttgtttaattgtattaatatgttttttttgttattttttgggatttttttagtagttattgttaatttttttaaagggtggaggtgagatttatattatgttattttgtgaagtgttggtagaagggtaggtaatttagtttattgaggtttgagggtggtttatttggttttttttgtgtttattgaaaagatgtaattatgagttgattgttttttatagagtttagaaaataggtttgttgtaggtggttgtagaaaagaaatgaataagggtaatgataatggggttttggttattgggggaaatatggttattatttgggttgatgattttggttggtatgttgatagaggtgtgagtttaataaattttaatttatatgatgttttattattttaatatttatttatttatttatttttaaatttagtttttttttaagttttatttttttttgttgagggtttaatttagttataattattttatttttgtggtagtgttaatttatagt

SEQ ID NO: 408 - DNA, 4489 bp, Artificial Sequence
  chemically treated genomic DNA (Homo sapiens)
taaaaagatttaaaaagataatgtataaaagatttaagaattaaaaagataattttagaaagaggaaatttaaatagttggtaagtttttgaaaaagtgtttaaattttttagtgttttgggtagaataaattaaaataataataagataaagttatatttattaagttgggaaaaaggaaaaataatttttggtgagatagtaaaagtaaagggatttattatatattgttgttggggtatatattggtgtatttattttggaaaaggtataattagtgaagttgaagataaatatatgtattttataaaaatttatggtaatgtatattaagaatatatgtataagaatatttataatagtattgtttataattattaaaaatggaatataatttaaatgtttattaatattagattaaattgtggtttatttttattaagattttttatattatatttattatattatagattattataatttaatataagaattagagttaaatgtattaatagagttatattttagttgtatgagagaaaaagatatataatgatatgtaatatataatttatttatatataattaagaaataggtaaaatgaatttaaattgtttaggaatgttgatataggtggttaagaaatattaagaaagaaagtagtaaatgattgttataaaaattagtatagtgttaattattgaaaagaattgaggaaagggatgattaggaatagaatggagaggggagttttttaggtgttatagatgttttagtttttgattgtggtagtgtttatatagagtttatattttatagttttttattatattatgtattgatgtttgtatgtttaaatattaaatgtatggaaaaagatataaaatatttaaaattgtagttaaggtatattaattgttttgttggtattttttttttttattataaagtggtagataattggttatattataaagatagataattggttatattataaagaaaattttaaagtataggagtttagttttgattttattggatatgattattgtatataatatagaagatattaagggttaagtaatgatgtataaatggggtttattgtttaaatttatagaaagtaaaatgtggaaaattagtaattttaattgatagtgtatatttaaagaatttatattggttgggtgtggtggtttatgtttgtaattttagtattttgggaggttgaggtgggaggattatttgaggttaagagattgagattagtttgattaatatggtgaaattttgtttttattgaaaatataaaaaaattagttaggtgtggtggtatatgtttgtagttttagttatttgggagggtgaggtaggagaattgtttgaatttaggagatagaggttgtagtgagttgagattgtgttattgtatttgtttgggagatagagtgagattttgttttaaaataaaaaataaataaaaagaatttatttaatagaattaagtattaatataataaatatgaagaattttagatttttggtttttaaaaaatatataaagatgatatttttttaaaatatttttataaaatatattgagattgtgatgttttatattgattgtatgaaaataatgaaaaagaattagtattgttttattataaaagttttattaatgtaaatttataaatttttttttaaatattttgagttaattttaattttatgatagaaatttattatttttagtaaaaatagttggtatttgggaaattaaaggtttaaaaattaagaatagtaattaaagaaatttgataaaatagtttttttaaaatttttatttatattataaggggaaattttgattatgtttttttttttttattaattgtagaatttaatattaaggattatataattttatatttttttttgagaaaaagtaaaggttttgtgttgtagtaataatgtaagatatggagggaagttttatttaagatttttttgtttgttttttttttaaagttattttagaatattagggagggttgagaggtaaggtatgaagggtgtaatatttaatatgagtaatgtgtgtgatgtatttggttaaaatgtatatagaggatttgtttttgtttttagatagaagttttttgttttgtagttatgagggttaattgttgaggttttatagttttttttttttttatatttggattgttatgttttttatttattattttgatgtagaggtagatttaggatttttgtatttgttaaggattttttggtaagtttatggggtgggagtggttataagatggagtttgtttggttttggtttttttggtttatataagtttgttttttttttaatttttaatttttatagttttttatttttttatttttgatttattttgtgttattgatgtttttggtttttgtttgtagtaagtttatttttattattattttttgtataaaagtttgtatttattaggttaaagaggggaattaatgtttgtaggaattgttttattgaattgtttggttgtgttttttgttagattttatttgttgttgtggattgtatataattatttttggtatgttttgtgtatgtattattttttttattttgttttttttttgtttaaatatgtgatttttttttgtttttgtttatgtttatttttgtttttttatttttttttaggaaggaggagggagttgggggtgttaaaagtgtagtgattttttttttttttttgtttttgtttttgtattttttgttataatgttttttgggttgttagtgttttgatgttttttgggaaaatagtttatttttttttttttttttttttttgtttttaattaattagttatttgttagagagggatatgtgtagtgagtgttttttgttttttttatttgaatttttttttttttttaagtagagagattttagtagtagtagtagttgatgatgaagagagaggtagtggtagagggggggtattttttatttttatttttaaagggataggatattaattttattttattttaattttgaatttaggggggtggggggaaggtggttgagtttttttttttattttttagttttgagttttgagagggggattgagtttgagagaggagaaggagtttttttttttttgaaaatttttatttatgatttttatttttttatttttttaatttgtttttttttttttattttttttttttttggttgtgagaggaggagagaaagaaattaaaagttttttagtaatatagattttttgttgttgttgttgttgttgttgttgttgttgttgttgttgttgttattgttgttgttgttattgttgttgtttggttttggttggagatattttattatatttaggagtagttatttttttagttttttttttttttttttgttttttttttttttattttttttttttattattttttgtgttattttttatagttttagggaaggtatttaaaagtggggggtaggaaaggtaagtgtgtttgtgggggttttattgtttttttttggttttgatttttattttggggtaatagtagtattaaattatatatgtagtggagttttggggtgaggagggggtggtgttggggggggtgaaggaggggttggagtagggaggggtgtgtgaggtggggtgtttattttgttaggggaggaagggtatttttatttttatttgttgttgttaaaagtggttttttttttttatttaatatttgattgtgttttgttttagtgggggagaatataaaaataatttttttttttttttaatgaggtgttagggaaagagatagaaagaggtatattttttagatgttatttaaaaaaaatttattggagagttttttttttttaggaaaagttttattgtatttgtttttgagtgggaaaatgttgggatttggattgtattggaattgtttatttatttgtagatttgagtgtttttttttttttggttttgtatgagatttggatattgattttagtgttggaagatttgattggtttttgttttaagggttttattttttatttttttgttttgtttgatttttatggaaaattttaaatttttagttggtagaggtttttggttaggttttgatttgtattattgttttttttttggttaaatgtttgttttatatattagtatataaagtttaaagttttaaaatgtttaaagtttaaatgttattgttattgtttgtttttatatatgtttttgatatttattttttatatgatgagaatattagttattttataattaatttgggtatatttgtaatttttgtaatttgtttgaataagtaatttttattgaaaattttatgttgttttggttgtatggaaggttaaatttttttattaatagtttgttgga

SEQ ID NO: 409 - DNA, 4489 bp, Artificial Sequence
  chemically treated genomic DNA (Homo sapiens)
tttagtaaattattgatggagaggtttggttttttatgtagttagaataatataaagtttttaatggggattatttgtttagataagttataaagattataaatatatttagattaattataaaatagttaatatttttattatatggaaaataagtattaggaatgtatgtgggaatagataatagtagtggtatttaaattttaagtattttagagttttggattttatatattgatatatgaaatagatatttaattaaaaaaaaagtaataatgtaagttaaaatttaattaaaggtttttattaattaaaaatttgaaattttttatggaagttagataaaatgaaaaaatggaaaatgaaatttttaaagtaaaaattaattaagttttttaatattgaagttaatatttaaattttatataggattaaaaaggggaaaatatttaggtttataaatggataagtagttttaatataatttagattttgatatttttttatttagaaataaatgtagtggagttttttttggagaaaaagagttttttaatgaattttttttaagtgatatttagaaagtgtgtttttttttgtttttttttttggtgttttattggaggaaggagggggttgtttttgtatttttttttattggagtaagatataattagatgttagatggaggagagaaattatttttgataatagtaaataaaaataaaagtgtttttttttttttgataggatgggtattttattttatatatttttttttattttaattttttttttattttttttagtattattttttttttattttggagttttattgtgtatgtggtttggtgttattgttgttttggagtgaaagttagagttagaggaaggtaatgaagtttttatagatatatttattttttttgttttttatttttgagtgttttttttggagttgtggaggatgatataaagggtaataaagggggggagtggaggaggaggaggtgaaggaggaggaggagagttggggaagtggttgtttttgggtgtagtgagatgtttttagttagggttaagtagtagtagtagtagtagtagtagtagtagtagtagtagtaatagtagtagtagtagtaatagtagtagtaaagggtttgtgttgttaagaggtttttggttttttttttttttttttttatggttaaagaggaggagggtggagggagggaggtgagttggaggggtgagggggtaggagttgtggatgggggtttttgaagaagaagaaattttttttttttttttaggtttaattttttttttagggtttagggttggagggtgggggaaggaatttagttgttttttttttatttttttgaatttaaggttgaagtggggtagaattagtgttttgtttttttaaaaatagaaataaaaggtgttttttttttgttattgtttttttttttattattagttgttgttgttgttggggtttttttgtttgggggggagggggggtttgggtagaagagatgggaggtatttattgtgtatgtttttttttgatgggtggttggttggttgaaggtaggaggagggggaggggaggaaatgagttatttttttagaaggtgttgaggtgttagtgatttggaagatattgtagtgggaggtataggagtgggggtggggaggaggaggaagttgttatgtttttaatatttttagttttttttttttttttaagggaaagtggaggaatggaagtgggtgtggatggagatgaaaggaggttatgtgtttgggtgggagaggggtggggtgggagaggtagtgtgtgtgtggggtatgttgggagtggttgtgtatggtttgtagtggtaggtgaagtttagtagaggatgtggttaggtgatttggtgaagtgatttttgtaggtgttggtttttttttttgatttggtaaatgtaggtttttatgtgagaggtaatggtgggggtaaatttgttgtaaatgaaggttaggggtgttggtggtgtaaggtgaattgaaagtgggaggatggaaggttgtggagattgggaattgggaagggggtaggtttgtataggttgggaaggttaggattaggtgagttttgttttgtggttatttttgttttgtgagtttgttgaggaatttttgataagtgtagggattttgagtttatttttgtattggggtagtaggtgaggagtgtgatggtttgagtgtaagagagaagggaattgtgaagttttagtaattgatttttatgattgtaggatggaggatttttatttagggatagagataagttttttgtatgtattttgattagatgtattatatgtgttgtttatattggatattgtgttttttatgttttattttttaattttttttggtattttggagtggttttggggaaggagtaggtagggaagttttgagtggagtttttttttatgttttgtgttgttgttataatataaagtttttgtttttttttggagagggatgtgggattgtgtagtttttaatgttgagttttatgattgatgaaggagaagggatgtgattaaagtttttttttatagtgtagatgagagttttaaaaggattgttttgttaagtttttttggttattatttttagtttttgagtttttggttttttaaatgttagttgtttttgttgaaaataatgaatttttattataaaattagaattaatttaaaatatttaagaaaggatttataaatttatattagtaaagtttttatagtgaaatagtgttggtttttttttattgtttttatataattaatataaagtattatagttttaatatgttttgtaaagatattttgaaggaatattatttttgtatgttttttaaaaattaagaatttaaaattttttgtatttattatgttggtatttaattttgttgggtgggttttttttgtttgttttttgttttgagatggagttttgttttgttttttagatgagtgtagtggtgtgattttggtttattgtaatttttgttttttgggtttaagtagtttttttgttttatttttttgagtagttgaaattataggtatgtgttattatgtttggttaatttttttgtgtttttagtagggatggggttttattatgttggttaggttggttttgattttttgattttaaatgatttttttgttttggttttttaaagtgttgggattataggtgtgagttattgtgtttggttggtgtaggttttttaggtgtatattattagttaaagttattaattttttatgttttgttttttgtaagtttgggtagtggattttgtttatgtattattgtttagtttttagtattttttgtattgtgtatggtaattatgtttgatggaattaaaattagatttttgtgttttaaaattttttttgtagtgtaattaattgtttgtttttatagtgtaattaattgtttgttattttgtaatgaaaaaaaaaaatattagtaaggtagttaatgtgttttagttataattttaaatattttgtgtttttttttatatatttagtatttaagtatataaatattgatatatagtataatgaaaaattataaagtgtgaattttatgtaagtgttgttatagttaagaattagaatgtttgtggtatttgagaagtttttttttttattttatttttgattatttttttttttaattttttttagtggttaatattatattgatttttatggtaattatttattgtttttttttttagtattttttaattatttatgttagtatttttaagtaatttaggtttgttttgtttgttttttaattgtatgtaagtggattatatattatatattattatgtattttttttttttatgtagttgggatataattttattagtatatttagttttagtttttatattggattgtagtaatttatagtataataagtatagtataaaaagttttaatggaaatgagttatagtttagtttaatattaataaatatttggattgtgttttgtttttagtagttatgaataatgttattatgaatgtttttgtatatgtatttttaatgtatattattatgggtttttgtagagtatgtatgtttatttttaattttattagttatgttttttttaaagtagatatattaatgtatattttgatagtagtatatggtagatttttttatttttattgttttattaagagttatttttttttttttttaatttgatgaatgtggttttattttattgttgttttaatttattttgtttaggatattaaagagtttgagtatttttttaaaaatttattggttatttgaattttttttttttagaattgtttttttaatttttaaattttttgtgtattgtttttttaaatttttttg

SEQ ID NO: 410 - DNA, 4395 bp, Artificial Sequence
  chemically treated genomic DNA (Homo sapiens)
ttttttttgtatgttttgtttaagttttatattgtattgatttttgtgtttttgaggtggtttgtttttttgttaaaaaaaaaaaaaagttttaaaaagagttattatttaattttttattgtattaaaaatagaggatatttttataatatttattagtaaattaatttttaaatgttgttttagttaaattaattaattatatatattataataggtttagatattttggaatattaatagtaggaggaaaataggaaaatataaaataatttgaggttttttattagtatttttttaagtaaatatatttgttttttttttggttgttttagataaatggaggatgattaaatttgttataattgaaatagaaaagaaaaattagagataaaatatattgaaatgattaaattttataaaaatataatataattttaagataaaataatattaaagtagattaatttttttattgttaattgttagaagttgatttagaatttgtaaaaattaatttgaaatgtataaattaggaaattttgggatttttttaaggaattaatgtaagttaagaatggatgagatttaaatttttaaggtaaatatattatttattttaaaggtaatatgttaatttatttatgttatatatagtatagtgggattataggagttatattgtatttaaattatttttagggaatggttttgttagtatttttgaatgaagagaggggttagaaggtaaaaaggaggaaaaggagaggtaaataatgagaatagttttatgattgtttttgatatattgtagtgtggttgtattttagaaaataaatatttagataaattttatagattgtggaggaggagaataagtaagaaatagattaatgtggattgtgggtattaagtattattattggaatgttgtttataaaaatgttttgaatttttaagtaattttgttttttagtattttttaagttgtgaaattaattttttttaattttaatttgatttaatattaaattaatatatagaaattgattattaatttgagaaatgtgatttttgaaagtattatattgggttaggtttttagtgttaaagagattgtgatttgtaatttaatagtaaatttgtaatgttattataatttaaatttgttttatttttgtatttttgatttaattaatatttttataagataaaatattagtaaaatagtaagtaagttagtttttataatttgattttttttttatttttttttatttattttgttatttaatgatataaaaggtttatgtttttatatttttatttaaaatgaatttgggggagagaataatttataaatattttttgaattaaagtttattataggtttatatatttatatttaaatattattttaagaaatgtatttaggttttgatattaatatttaaaatattgttaattgtgtgttattttatgttttagttagtttatttgtattttaaattaaggtattggttgttgttgttattgtgtgtttttataggaaaaaaaaaattaatttaatttgttatgattttgtttatatttagaatatataggtatgtatattttttagtattaggatgtgtatttgtttattttgttttttttgttttgatgaaattatattatagattatgtattgtgtttaatttagtagtaaattttttttaattgtgtggtttgtgattaatatttttatttttgtttagtaatgatatatttttattatatatttttttatattgttttttatttgatgatttgtgatattattttttttttatttttttttatttttatattgtttgtgttattatatatttataaagtgatattagtggtttttagggtggaaaggggtggaagttgatttttgtttttttttttagtgttggttttaggtgtgttttttgttattttttgtattgtgaataggggtttgttgagttttgggagtttttagaagaggaagatttttttggttttattaggtattatttgtgtttttttgttttttatttgtgtttttgtttgggttaatttttgttgtatgtgtttatttttgaattgtatgttattttttatttttggggggtttttgtgtattgaaagattgttttttggtaggttttgggatttggtgatggttgattgtgtgttgtttttatgtttggttttatgatgttgtaatatagaaagtttatgttggttttgatttgtgtgggattgtagggtttgttggagtgtggtgtagaggttttttttgtgtgtttggttttgggaaaggggtgggagggttggttttgggagtgtatgggtgtggtggggagggtatttattgtgaagtatgttgtgtttatggattatgtttgtgtgttatattagaggttttgggttttattaattttatttagagatgggaagatttttagtggtggggggaggatagggttgagaggtgttaaagatgtaaagtaagaaggaaataaaggggggttgagagggagattgagaggaagggggagttttgagtttatgttgtagttagatttggatgagtttgttttttgttttgggtgggtttttgtttttgttggtttttagtgttgtgtagttagtagtatttttattgtgatgtttgtattatatttgggtgttggttgttattatttgtgttgttgttgttaggattttttttttgggtattgttgttgttgtggggttgggaggatgtggtgtgtgggaggtggtggttgtagggtgagttttgggatgttttgagttggggttggggttggggagagggtgtagtgaggtgggggttagtttagattgatggtagtgatggagtgggtggtggtggtggtgttggtggtggtggggtggtttagtttttagttttagatgtgttgtgtagtaggttggagtagtttttttgggaggatgtttagtggtagtgttttttgttttagtttttggggattttttgttgaggtattgaaggtaggaagaaggggtttgttattggtttgttgggttgtgtgttatttttgttattttgtggaaagaggagtgggtgggtgggtgtttgggaggtgggttggagggtggtgtaggggagtggggtggttggggggggggttggggggtggggaagggagggaggagaaaggagttggaagagggtagagttattaaatgggttttttagttatggtttggggttttatgatttttttggaagtttggagtttgggtgggatagtgaggttgtgtgtggttggtgttttggggttggtgtgtggtagaatggggttgtggtggtggtagtaaggatattttagttgtgtggatttgggggaggggtggggagggggtgaggatttggttgggatttgtggtttggtttgttagggtgtagagagaggatgtagttgtaaattttgagttggatttttgtgttggatggaaggtgtggaagtgggaggggtttttgtgtgaaaattttttgtggggtttggtgttttattttttaaaggttagattttgtgggttttttgttttttatttttttttttttatttgtgtaaaggaattgggtgttttttttttttttttttttggggtgtaggttttgttgtggattttgtgtttagtttgggagatatggtaggggtgtgttttagggaaaggtggttgtaaaagttttgtggttgagtattgggtttgatgtttagtttttttattaaattatttttgtaaagatgtgggttttttgtaattgagttttttattttgaggtatttaaaattattttaaggtatatatggatttttgtttttttgtgttatttttttttataggtttgtgtggtgtgttaaagtttgggagatatgagttgtggggaaatagtattggaagagtttgggtttgtaaaatgtgaattaatgaatatgaaataagggtaattgtgaggtagtgttgggaagggttggagtgtgtgggggtgtagggagtttttttttgggtgttgtaatggtatttttttttttttttggttttgttttgtttttttttggtttttgtggatgtgatttatgtagattatagttgagtttgttggattttgggattatggaagttattttgtttggttatttatatttgtgttgtggttggggtttgggttggggattgtggtggtgaagaagttggggtaggaagagttaatggtaatggtggggttgttggggggtggggggttagtagtagatgttgagttgtgaagattagggtggttttgaaaggttgaggaaaggagaaagggttatgagaagagtttggtga

SEQ ID NO: 411 - DNA, 4395 bp, Artificial Sequence
  chemically treated genomic DNA (Homo sapiens)
ttgttagattttttttatggtttttttttttttttttggttttttggggttattttagtttttatagtttagtgtttgttgttgattttttgttttttggtgattttgttattgttattagttttttttattttggtttttttgttgttatagtttttaatttaagttttagttgtggtgtgggtgtgggtggttggatgggatggtttttgtagttttggggtttggtgggtttggttgtggtttgtgtgggttgtgtttgtagaggttgagggagggtgggatggagttgggaaagggaggaggtgttgttgtggtgtttagggagggattttttgtatttttgtgtgttttagttttttttggtgttgttttgtggttgtttttattttgtatttattgatttgtattttataagtttgggtttttttggtgttgtttttttgtaatttgtgttttttagattttaatgtgttgtgtgagtttgtaggaggaagtggtgtgggggaatgggggtttgtgtgtgttttggggtggttttaaatattttgaggtggggggtttaattgtaagaagtttgtgtttttgtaggagtaatttggtggggggattggatattaggtttagtgtttaattgtgaaatttttatggttgtttttttttggggtgtgtttttgttgtgttttttaagttgagtgtggagtttgtggtgaaatttgtgttttagggagggagggagagggggtgtttagtttttttatgtggatggaaaagaaggggtgggaggtagagagtttgtaaggtttaatttttaaaaagtgaaatattaaattttataagggatttttatatgaaggttttttttgtttttatgttttttgtttggtatgaggatttggtttgggatttgtggttgtattttttttttgtgttttggtgggttgagttgtggattttagttgggtttttattttttttttgttttttttttagatttgtgtggttgggatgtttttgttgttgttgttgtggttttattttgttgtgtattagttttggggtgttggttgtgtgtagttttgttattttatttaggttttgggtttttaggagggttgtggagttttaagttatgattaaggagtttatttggtaattttgtttttttttggtttttttttttttttttttttttttgttttttggttttttttttggttgttttgtttttttgtattgttttttagtttgttttttagatgtttatttatttgtttttttttttgtaagatagtagaggtggtgtgtagtttggtgagttgatgatggattttttttttttgtttttaatgttttagtggaagatttttaagggttggagtgaggagtgttgttgttggatatttttttggggaggttgttttgatttgttgtgtggtgtgtttgagattggggattgagttattttgttgttgttggtgttgttgttgttgtttgttttgttgttgttgttggtttggattggtttttattttgttgtgttttttttttggttttggttttggtttggggtgttttggggtttgttttgtgattgttgttttttgtgtgttgtgtttttttgattttgtggtggtgatgatgtttgggaggagggttttgatggtggtggtgtggatggtggtggttggtgtttgggtgtgatgtgagtgttatggtggggatgttgttggttgtgtggtgttgagggttagtgagagtgagagtttgtttggggtggaggatggatttatttggatttggttgtagtgtgggtttggagtttttttttttttttggttttttttttggtttttttttattttttttttgttttgtgtttttaatattttttgattttgttttttttttgttattggaagtttttttgtttttaaatggaattagtggagtttggagtttttggtgtaatgtatagatatgatttatgggtgtagtgtgttttatagtgagtattttttttgttgtgtttgtgtgtttttggagttagtttttttgttttttttttggggttgaatgtgtaggaaaagtttttgtgttgtgttttggtggattttgtagttttgtgtgggttggggttgatgtaaattttttgtattgtagtattgtggaattgggtgtgggggtggtgtgtggttagttgttgttggattttaaaatttgttggagaatggttttttagtgtgtaggaattttttgggggtggaggatagtgtgtagtttagggatggatatgtgtggtagagattggtttaagtgagggtgtaggtggaaagtgggagagtgtggatgatatttagtggggttagaggagttttttttttttaggggtttttggagtttggtgggtttttgtttgtagtataggaggtagtagaaggtatatttgaagttagtgttggagggaagggtgagggttagtttttatttttttttgttttggagattgttgatgttgttttatgggtgtgtggtaatgtgggtagtgtagaggtgggaaggaatgagaggaaaatagtattatgagttattgagtaaaaggtagtataagaaaatgtgtggtggaaatgtattattattaagtaaagatgagagtgttgattgtgggttatgtagttgagaggggtttgttgttgagttaaatatagtatgtggtttataatgtgattttattaaaataggaagagtggagtaaataaatatatattttgatgttgaaggatgtgtatatttgtgtgttttgggtgtgagtagaattatgataaattaaattgatttttttttttttgtggaaatatatagtaataatagtagttagtgttttaatttaaaatgtaaatgaattggttagagtataaagtaatatataattgataatattttaaatattaatattaagatttagatatgttttttagagtgatgtttaagtataaatgtataagtttgtggtgagttttaatttaggaaatatttgtgaattgtttttttttttgaatttattttaagtgaaaatgtgaaaatatagattttttatgttgttggatgataaaatgaataagaaaaaatagaagaaaaattaaattatgaagattagtttatttattattttgttagtgttttgttttgtaaaaatgttgattagattaagaatatggaagtaaaataagtttagattataatggtattgtagatttattgttaagttatagattatagtttttttgatattggaaatttgatttaatataatgtttttggaaattatgttttttaaattaataattaatttttatatattgatttggtattaaattaagttaaggttagaagagattaattttatagtttagaaagtgttgagggatggggttatttggaggtttagaatatttttgtaggtaatattttaataatggtgtttaatgtttataatttatattaatttgttttttgtttattttttttttttatagtttgtaggatttgtttaagtatttattttttaaaatatagttatattgtagtatgttaggaatagttatggagttgtttttattgtttgtttttttttttttttttttttattttttggtttttttttttatttagagatgttggtagagttattttttaagggtagtttagatatagtgtgatttttgtagttttattgtattgtgtgtgatatgagtaaattgatatgttgtttttagagtgaatgatgtatttgttttaggagtttgggttttatttatttttaatttgtattagttttttaagggagttttaaggttttttgatttgtatattttaaattggtttttgtaagttttgaattgatttttaatagttaataatgaaaaaattaatttgttttgatattattttattttgaaattatgttatgtttttatgggatttgattattttagtgtattttatttttaattttttttttttgttttagttgtagtaagtttaattattttttatttgtttggggtaattaagaaaggaataggtgtgtttatttagaaaaatgttagtggaagattttgaattattttgtatttttttattttttttttattgttaatattttagaatatttgaatttgttataatatgtataattgattggtttggttaagataatatttaaaaattaatttattaatggatattataagaatgttttttatttttagtataatagaaaattggatgatggttttttttaaaatttttttttttttttaatagaaaagtaaattattttagaaatatagaagttagtgtagtgtggaatttggataaaatatgtagagggag

SEQ ID NO: 412 - DNA, 10490 bp, Artificial Sequence
  chemically treated genomic DNA (Homo sapiens)
agaaggtgtttgttttttttttgttttttgttatgattgtaagttttttgaattgggagttgattaaattttttttttttataaattatttaggtttaagtatttttttatagtagtgtgaaaataaattaatattttttttttgaggtgttttttttttaggtaatttgttgtttttatgttttttttttgttttttgtttttttttttttttttatgaggtttaagtgataaatggggttagttttagttttagttttagttttagttttattttattgtaggtttgtgtggttgttggagaggttgtgttttttttttttttttgagtttgtttgatatgttttttggattttggaggaaattgattttttatttttatattggtgtaatattttttaagattttaaagttgtattatttgagttagtttttttttttatttttatttgttagggttgttattgggatagttttagagggtggtgttaatggatgaatggatggatggatagtagtttagggatgatgtttttgtttgttttgaattgggttttttttttaatgagaagtttttttgagtgagtatatatagttattttttggtatttatggaggattagttttagggtttttgggaatgttaaaatttatggatgtttaagtttttgatataatgtggtttagtatttatgtataagttatgtatatttttttgtatatgttagattgttattagattatttatgatgtgtaatataatgtagatgttatataaatggttgtgatattgtattttttagggaatgatgataagaataaagtttgtatatgtttaatagaaatataattgtttaatttattttttgaatattttttatttgttgttgttgaatttatagatgtagagtttttggatatgagagttaagtgtgttttgagagtagggtgggtgaggttgttaatgagtataggggagtaggtgttgattaggaggattttgtattggggtatttggatgttttgttttaggatttgagattttagttggatggtataggtagatttagtttaggttaaagttgtttttttgaagtttttttttattttaagttttttttggattttggaatttggtattttttaggttttgtgtggaaggatagatgaattaggttttagataatatgtttagaagagtgagtttttattgtgtgtttggtattttttttataggattttttagttagaatatttaagggttatggagagaaatatttagttaaaatattagaaaagaaaaagtgatattattagagatattaaaaagattattaggtaatagtattagtttttgtattttgagatttaatagtagtagttatttttttttattgttatgtgtattttaggattattttgggtggggagggttgtggttagggagtagttatggatgttttgatgttggttttgggttttgggggtgatagtgatgaggaattgggtgtatatatgagtggggtagttgggtttggttagagaagtagtatatatgtgtatagatgtgtttatttatatatatatgtgtatgtatgtgtataaatatattgtaggtaggtatgttgatgttttaggtagtggaggattttgattttgggtgttgttgatttgggtaaggttttattgtgatttgtgttatgattttagaatgttattggtgtttagtatttgtttgttttttggtttgttttagtggtttatagtagttatatataggtagtggtatttgtgagtagttttgtggatttaaaggttttttttttgagaggtatgatttaggttagttgatttattagaattaggtgagtgtgatttgtttttttttttttaggtggatttggggatagtggttatggtgtgggtggtgttggtttttgtggggtagttattgaggagggttatttttgagtatttattaggtgtttgttttatattgtttgtgtagatgattggtttttttgtttttatggtggttttgtagagtgggtgttgtttttaaatgtttttatttgatagatgagatgtttggggttagagaggtagtaattggtttgggaatttggatatgattttgagttttgtttttagttttgttgtgtgttgtgttggaatttaggtttgaattttgtgatttttttgttttagattttaaatttgtttaggttttttattttgatggggtagagtttggttttggtagagttattggtatagagttattggtatagatttattgatggtttttagaatatttttgtgttttaagttgggttttgatggttgttgtgggttttattgaatatatatggttttttgtttaggggagtttgttgtttttgggtagttgtggaaaatgaaggagttttggagggttggttgaggggagattatttttttttgtgtttaaaggggtttgggtattagggttttttttaggtattttttgttttgtgtggtttttttgaggttttgttttttttttgttttgagtatttttaggagggatggtttatttagttgttttttaggattaaggatttattgtttttttttagtgatttaggaaaatgaagtttttttttgttgggatggtttagaatggtggattttatagtttttttgtgagagatgtggtttttatgtgtataatagattttttttattttttaaatttaatatttttttgtttaataggtgttatttttaaagtggttttattgtttagattgaagagttatggtagttaaagtgatgagtggagtagaattgagtagttgggagagattttgttttttgtaggaaattgggtattgttgaggttttgagtattttaggaggttgattgtatagagatttttggttgttgattttagtttgtttttatatttttggaatagtttattatgggttttttatttttggtaggtggaaattatttaatttgttggggttggtgtgtttttattttatggtattgggggataataggattttttgtttaggttttattgtatttaagtttttgggaagatgtttatttttgtttgggatttgagattttagagattggagtagttgtgggttattgggtttggtttttttttttttgggggtggtggtggaatgggggttatgtagttagttagtatttgggagtttggtgagagtggtttaggtgttttttgaagttgttgtgtatagtgtgatttttagataattttgttttataggatggatgtggtagaggttgtgggtagttggtgggtataagagtgagaggatattattatgaaatatgaaaaggtataagttggtttgttttttggagggaggttttttttagtgtgttttggttaaagggttttgggttttttaggagtatagggtagggatgggtggttaatgtttttaggtttttgtattttttattttggattttttattaaggttttttttgggttatagggatattgagttgggttgttagaggataaggggtttaagtttttttgaagttataataataatgttgattatttggggattgtatagtgagttttttgtattttttttatttttaaagtatttgttttagtttagggatgggtttgtttttagaaaggtttttttgatgtaggatatgttttattaggttgggttaattttttttttagggatagaatttttttttgatttttttgtaggtttagtttgaggttgttaggttagaggtgtggggtttatttagggagttggtgggaatggagattgggttaggttaggtttttgggtgtttagtagttttgttggtaagtgagtataagaggagtggggtagtttgagggtttggttttgtttatttggagataattttggtgagatgtaagggttatggttatagggtgaggggatgtttggtttagttttagggttgttgtttagtaggtttttgagggtttatttgtttttgtttttttttatttttttagagttatagtttttattgttttgtgaggggaaaaggtatggtgataatgggggttgtagttttaggagaatgggggagaagatgggtagggttttgttttgggtattttatggtgaggttagggaggtagtagggtttgtggttaaagatttgggtttggtgttgggaagggatttggggttgggtaagaggagtttagttaggagtttattttttagggattataggatggagagatagaggatttttggggaggtagggtgggagggagttgatgagttgtgttatttttgaaatgtagggtgtgtggtttgggtgtagggagaggtaggtggatgttgggaggttagaatttgtaagggttttggggttgttaagtggggtgggtttttggtgtagttagagtatattgggtaggttttagggtaggtttttttgattttggtggggggatgtggttattttttgagggatttttgttagggtttggttgtttattttgggtggtttttattttattttagggttaattttttttagttttagtagaaagtattattttgagtttaggatgggtagttttattgggtagtttgattgttttttatgttaggggttttagtaattttggttaggttgtttttatattttttttttttttaggttttgttttttttgggagttagttttataggaaggtttttgtttttttttttttgtgtttttttttgggttgagttttgagttggaaagggatagagttagttttttttgggggttggtatttaggttggggttgttttaggttttgtgtagttttttagttttgtttgggttgttttatagtgagatggagttgttttttttgattgtgtgggaggtgaaggtaagagtttgatgtgtggaggggttggtttagggatgtagggattgggtgggtggttagtgaggtagaggaagtagttggtttgagtggtggtgggtgagggtaatatgttgttattgggaggggtagtagtttttgttggatttgattttaggttgttgtttattttggtagtttgataaaattttaaaaggagaattatagttttggtttgggggtggttgtgtgtttgtgttaggattttatttagaggttgggatttaagattggtgtgtttgtggtttgaggatggtatattttggggttttaaagttagtttattggtgtttatttgtttaaaggtttttagtttttgaggtttgtttttttttggttttttttagttggtttttattagggttttagagtttaagatttagtatttgtgggtggttttgggaagtttggtagttttgttaattttaatatgttttatttgatagtaaatttggtgggagattagttgaaagagtaagtgggtggatatgttgggagattgggagaaatataaaagtagtagaaaggtaatgtgtggagggaggaagtattttttgtagagataggggataggtatttatggttgtggtttggtattattagttttttagagggtgggtggtatattgtttttgtttagaggattgtaggtttggttgttagattttttgtttatttgtgtaagtgttattttgtagggagggaatttgaatttagggttgggattatttggagtttaaggttagggatgttttggtgatttgaaggaaggaaaaggtttagattagagttttgattttgagtgtttatttatttttttagttttgggaagggagattttgttttagtttgattttatttttattgaggaattatggggttaaaattgataatttttagaatttttgggttttggtttttattggggttattttgtggtttgtgatattagattgttttttgtttatagtttatagattgagtgtataagggaatgtttatgaatatttggggtttgatgtggttagtttttttgaatattgaggaaatgaagttgaaaaattttggaagatattaggtatgtttagttagagtataataaataggataggttgtgttggggtttaggtttttagttggagggaatgttaagattattttggggagttgggggtgaaggttagatgaatattttgggtatagatggtgatatagttattatagataaatttagttttggtgattttttttggttttagtaataagttaaaatgtagttttttgtagaaggaaattttttttttgttttttttttttgaagtgttgattgtgggttgattgttattgggggtagggagttttttatttgttttgagattgttttttttttttggttttgttttatagattatgaaggagaagggtaagaggttatttgagtatatttagtgtattgattgggatgtaagtgggatattaaggaagtatatattttttagggattgatatggaattaagtaagtttatgggagttatagggttttagtagagatggggtgaatgagagggatgggggtttttttggagtagaagttagggttatttaggagggatgatatagttgttaagagtttttttggtttagggagtagttggtattatgaattgagtatttttttggttttaagttttgggttagattggaatatgtggggttagaatttaggaggattttgaggagatggaaggtagtaaataaaattatgtataatggtgaagggtgttttttttgatttatggggatttatggtaggatttatgggagggtggtaggatagagggtttatgagttttttttaggtaatagtgatagtattaaatgttgggagaattaggggttttggaaatttttatttaggtttgttgggaatatgatatggtatagttatgttggtagtttgttgggtagtggtttataaagtttgatggatttgaattatatatttttaaagtgttatagatattgaatttattgatttgtaaattgatatttatatgaaattagtatgttaggtttattgtttgattttttgttatttatatatggagtttttggggatggtttttaatatggggatggggagagtaaggttggttttttttttaaatggaagatttagtgagaaaagggaatgagttggtgatgtttgtatgaatgtgggtggattttagatgtattttgttgagggatagaagttagatttaataagttattatagtaggatttttatttttaggttattttggaaaaggttaaattatagggattgagaagtagtttgggtggttaggggttgatggattggggagaggttgggtgtataggggttattttggagatttggaggatgaaggagttgttttaggaggggttggagtggtggttgggagattttgtatattggtttggaattgtggaggaattgtatatttatagattgaattggtgtgtgtgtaaattgaaaaaaaaaaaaaaaaattatttagagtgaaaaggattaggtaagttattgtataattgggttatttgtatgttatagatgtggattttattgaaatatttttttaagagttttaggttttgaagagtttattgtttatttggtgaaatatttgaatttgaaatgggatttgttgttaggttttgtagataaagtgaaattaataatatttgtataaaataaattaaagttttttttttttgttttttaggtagtgggaattattttatatttttttggtatatgaggagtataatttggtgagtatttttggtagtgaggtttttgggttatatttttatattgataggagtgggtgtttggtgggggtgttgttgttttttttaaagttagtatttgtgatttattaggatataggaggtaggatgttagtttattgttggtataaatttttaaggaagggggtggttttaaggggttaagttgagatatagaggagttagggtttggatttttggtgttatttgggtttgattattattttttagaataagaaatgatgttttttttttggggttgttttaaagtttaggagtttggtagtattgtatataggatggtgttattagtagatattttggataaggtgttgaagtgtttgatggatttggtttttgttatgaaatgaatgtgtattttgaggaagttttttttttagaggaagttttttttttagaggaagtttttttagttatttttgttttttttaatgatatgagtttttttaggtgattttagtttttttaggtgatgtttttttatggtgattttggtttttgtaggaggtgggttattgtagggatttgagttatattgttgttttgttttttttttatttttttgaggaggatgtattttgggtattggtgtagttgttggttagtgagaggtattttttgtagggtaagtgaatagttgttttggggattttttgtagttagatttggggatggttattttggttaggtgattatagtttttagttaaggtattttttttgtgttgttagtttgttgggagattttaggatgtttttgttgagggttttataggagtttatggttgatttttaaagtttaaattagatgttttttatttttattagtagagggtattttattttttttgtggttattttttgtgttttggagttatgttttttggttttgattttgtgtagttgatttttttttttttgagagtttttttgttttttagttgtttgggtttttgttgttattggtgtttatgaatgggttgattaagtttaggtggtagtatttttttattttttgttttttggtttgattttattattaggagatgattgggaagtttagtgtttatttagttttggttattttgttgtggtttgaaagttaggtttgttttttttgtattttggtttaggaggtttttaggggaatttttagttaggttttagggaatgtttttgttttatttttttagggtaaaggttgtatgttggggttattagatgggagggtgggaggttttggggtttgggggtttttttagttgtttagtttttgtagttgatggttttatattttgggggaaggttttgattttatgatgggttgggggttttttaggattttatagtttaaatggtgggattgtttaggggttttaagattaataggagtatgtggtagttatgttataatttaagattatggggtattaggtgagtttatggtttttttagttttttttagaggttttgttttttgtggggttgtaggagtaggggggttggagttttttgtggggttggtgattggttgagttttagttagggtttgatttgggatgttgggttttttatgggttgggagttggtttttttttttgttttggaggagatagaggtatagggatgggggtttagtttttgtagagtagggtaaagggtagtgtgtttattgggagtgtgggaaggtgatagtgttgtggggagttttggatattgtttagtgttttgtattaggggaagggtttttagaggttttggaagagggaggtttttagggtagtttagtggtttgagtatttttgttgtttttattaggataagaaagatttatgtgggtagtgttttttgttaggttgttttatttggatattgattgatggggtaaggaggtatagggagattttggtttagggattttttttgttttgtagtgttttgtttttttagtttgggggtttggtttatttttagtttataggaggtttaggtgggtttttaaaggatatataagtaaaattttttgtttaaggggggttattttagggttatggttggggtttaggtttagttttatgggtagattgggttaggatttgatttgagagggtttagggaagttttaagttttgggtaagtttttttttttaggagttatatttttatttaaatgagtgttttttatgaggagttttaagattttgtttgatttagtgttttggagggtttaggtgatttttatggggaaggttattgattttggagattgaagttttagtgtgtgtagtttgagttattagttttagtttggaaggattaggtttttttatatttgttgtttttatagattttttttgggtttattttgtgtttgtgggatgtgtatttggtagaaggtgaataggtgttgatgttgataataagaattgtttttaaggtttagtagagtaagtttatgtgtgtttagtggggtttggggagttttggggttagattttgattggtttgagggtagtttttttatattgtttttatgattttttgttttggtttagagggaggtttggttaggtgggttgggtaggatattgtgatattgagtttattttttatatgatttagatgaaagttgagagtgtggtgagtatttttttgttt

SEQ ID NO: 413 - DNA, 10490 bp, Artificial Sequence
  chemically treated genomic DNA (Homo sapiens)
ggatagggaagtgtttattatatttttgatttttatttgggttatgtgggggatgggtttggtgttatagtgttttgtttagtttatttggttagatttttttttgggttagaatagaggattatgaggatagtgtgaggaagttgtttttgggttagttggggtttgattttagggttttttaggttttgttgggtatatgtagatttattttgttgaattttaaaggtgatttttgttattggtattaatgtttgtttgttttttattagatatatgttttataggtgtagggtgagtttgagagagatttgtggggatagtaggtgtgaaagaatttggtttttttaggttggggttggtggtttgagttgtgtatattggggttttagtttttagagttagtgattttttttatgagggttgtttgagttttttaggatgttgggttagataaggttttgaagttttttatggggggtatttatttgagtggggatgtggtttttggagagaggggtttgtttagggtttgaggtttttttgagtttttttaagttgggttttggtttagtttgtttatgaggttgggtttgagttttagttatggttttgggatgattttttttgggtagagggttttgtttgtgtgttttttggggatttgtttgagttttttgtgggttgggagtgagttagatttttgggttggggaagtagggtattgtagggtaaggaaggtttttgagttagggtttttttatgtttttttattttgttaattaatatttggatgaggtagtttaatggggaatattgtttatatagattttttttgttttgatggaagtaatagaggtgtttaggttattgggttgttttaaaaattttttttttttagggtttttgaagattttttttttagtgtagaatattgggtggtgtttagagttttttataatattgttatttttttatatttttggtggatatattgttttttgttttgttttgtgggagttgggtttttatttttgtgtttttgttttttttagggtaggaaaggaaattaatttttagtttatggagaatttgatgttttaggttaggttttggttgggatttagttagttattagttttatgaggggttttagtttttttgtttttatagttttatgggaggtagggtttttgggaagagttgaggggattataaatttatttgatgttttatggttttgggttgtgatgtggttattatatgtttttgttggttttggagtttttggatggttttgttatttgggttgtgaaattttgagaagtttttagtttattatgaaattagagtttttttttaagatgtggagttattagttgtaagagttgggtagttggagaggtttttaaattttaaggttttttatttttttatttggtgattttaatatgtggtttttattttggggaggtggggtgggaatattttttggagtttggttggaggtttttttggaggttttttgggttagggtgtaaaaagggtaagtttgatttttaggttatgatagggtggttggaattgggtgggtgttgggttttttggttattttttggtagtggggttgggttagggaataggggatggggagatgttgttatttgggtttggttggtttatttgtgggtattgatggtagtaggagtttgggtagttggagggtaggaggatttttagggaggggagagttagttgtatagaattagagttggagggtgtggttttaggatatagagggtggttatggggaggatgagatgttttttgttgatggggatgagaggtgtttgatttgggttttgggggttagttgtggatttttgtgggatttttagtagagatattttaaagttttttaataagttggtgatataaggagggtgttttggttgaaagttgtgattatttggttagggtggttatttttaggtttggttgtaggaggtttttggggtagttgtttatttattttgtagggagtgttttttattggttagtagttgtattagtgtttagaatgtattttttttaggaagatagaggaggaataaggtggtgatgtggtttaggtttttgtagtagtttattttttgtaagagttagagttattatggaaggatattatttgggagggttgaggttatttgggaggatttatgttattggagagggtagaggtgattggagaggttttttttgaaggagaggttttttttgaaaaagaggtttttttaggatgtatatttattttatgataagagttaagtttattaggtattttagtattttgtttaaaatgtttgttgatagtattattttgtgtgtgatgttgttaagtttttgggttttggggtagttttaggaggagggtgttattttttgttttgagaagtggtggttaggtttaggtgatattaggagtttaggttttgatttttttgtgttttagtttgattttttgagattatttttttttttggaggtttatgttagtggtgagttgatattttattttttatattttggtgggttataaatattaattttaaaagaagtaatgatatttttattagatatttatttttgttaatatggaaatatggtttgggaattttattgttgggaatatttattgggttgtattttttatatgttaggaggatgtggagtagtttttgttgtttaggaaatagagaaagggggttttggtttgttttgtgtagatgttgttaattttattttgtttataaagtttaatagtaaattttattttaggtttagatgttttattagataagtagtgagttttttagggtttgagatttttgaagaaatgttttagtaaaatttatatttgtgatatgtaaatagtttagttgtatagtgatttgtttgattttttttattttgaatgattttttttttttttttttagtttgtatatatgttagtttagtttgtgggtgtatagtttttttatggttttaaattaatgtgtagagttttttggttattgttttagttttttttggggtgatttttttattttttaagtttttagggtggtttttatgtatttagtttttttttgatttgttagtttttggttatttagattgttttttagtttttgtggtttggttttttttagaatggtttaggaatgggaattttattgtggtagtttattgggtttggtttttgttttttagtaaaatgtatttaggatttatttatgtttgtgtgggtattattggtttgttttttttttttattgggttttttgtttgaagggaggattagttttgttttttttatttttgtgttgaaggttgtttttgaaggttttgtgtgtgagtgatgaggagttaagtagtgaatttggtatgttggttttatgtggatgttagtttgtaaattagtgggtttaatatttgtgatattttggggatgtgtggtttaagtttattgagttttgtgagttattgtttaatgggttgttaatgtggttgtgttatgttatgtttttagtggatttggatgagagtttttaggatttttaatttttttagtatttggtgttgttattgttgtttggggggggtttatgggttttttattttgttatttttttgtgggttttattatgggtttttatgggttagggagagtattttttattattgtgtatgattttgtttgttgttttttatttttttaggatttttttgggttttggttttatatgttttagtttggtttagggtttggaattagggaggtgtttggtttatggtgttggttgttttttgggttgggagagtttttggtagttgtgttattttttttgggtgattttggtttttgttttggggaagtttttattttttttatttattttatttttgttgggattttgtggtttttgtaggtttatttggttttgtattgatttttgaagaatatatgtttttttaatgttttgtttatgttttggttgatgtgttggatgtgtttagatgattttttgttttttttttttatgatttgtagggtagggttaagaggaggaagtagttttagaatagatggaagattttttgtttttagtggtagttagtttatagttagtattttgggaaggaaggatagaaggaaggtttttttttgtagaaagttgtattttggtttgttattgaagttagggagggttattagagttgagtttgtttgtggtgattgtgttattatttgtgtttagggtgtttatttgatttttatttttagttttttagggtggttttgatgttttttttagttggagatttgggttttgatatggtttgttttgtttgttgtgttttggttgagtgtatttggtattttttggggttttttaattttatttttttaatgtttaggaggattgattatattgggttttggatgtttatgggtatttttttgtatgtttgatttatgagttgtgggtagaaaatgatttggtgttataggttatggggtgattttagtgaggattagagtttggggattttggaaattgttggttttggttttatgattttttagtagaggtgagattaagttgggatagggtttttttttttaggattgaaagagtggatggatatttagagttgaaattttgatttgaatttttttttttttttaggttattagggtatttttagttttgagttttgggtagttttagttttagatttagattttttttttgtaaggtgatgtttgtatgaataggtaggaaatttggtgattaggtttgtagttttttgggtgaggatagtgtgttgtttattttttgagaggttgatggtgttaggttatagttatgggtgtttgttttttgtttttgtagagagtgttttttttttttatatgttatttttttgttgtttttgtattttttttagttttttagtatatttatttatttgtttttttggttgattttttgttgaatttgttgttaaatgaggtatgttggagttagtggagttgttaggttttttagagttgtttgtggatgttgggttttgggttttggagttttggtgggagttagttggaaggagttagggaagggtagattttaagggttgagagtttttgagtaaatgagtattagtgggttggttttgggattttgggatgtattatttttaggttatagatatattagttttaggttttagtttttaggtggggttttgatataagtgtgtagttatttttaagttaggattgtggttttttttttggaattttattaaattgttaaagtgaatagtaatttggggttaggtttagtagggattgttgttttttttagtgatagtgtgttgtttttatttgttattgtttaggttagttgttttttttgttttattgattatttgtttagtttttatgtttttggattagtttttttatgtattaggtttttatttttgttttttgtgtagttagaggaggtagttttgttttattgtaaggtaatttaggtagagttgaggaattgtatggggtttggagtggttttagtttgggtgttgatttttagaaaggattggttttgtttttttttagtttagggtttagtttaggagaaggtatagggaagggaggataagggtttttttgtggggttgatttttaggaggggtaggatttgggagaagaaggagtgtagggatagtttggttggggttattggggtttttggtgtggggggtggttaggttgtttagtggggttgtttgttttggatttgaggtggtgttttttgttggagttgagaaaggttagttttgagatgggatgggggttgtttagggtgggtgattgggttttgataggagttttttagggagtgattatatttttttgttagggttaagggagtttgttttgagatttgtttggtgtattttggttgtattaggggtttattttatttgatagttttaaggtttttgtaggttttgattttttagtatttatttgtttttttttgtatttgagttatatattttgtgttttagaagtggtatggtttgttagtttttttttgttttatttttttagggattttttgtttttttattttgtgatttttgagggatgggtttttggttgggttttttttatttggttttagatttttttttagtattagatttaggtttttagttgtgagttttgttgtttttttggttttattgtgagatgtttagaatggggttttgtttatttttttttttgtttttttagggttatagtttttattgttattatgttttttttttttatgggatagtgagggttgtagttttaggggaatgggggagaataggggtaggtgggtttttagagatttgttggataatagttttgaggttgggttaggtgtttttttattttgtggttataatttttgtattttattggggttgtttttaagtagatagggttagatttttaggttgttttgttttttttgtgtttatttgttgatagaattgttgagtgtttaggggtttgatttagtttagtttttatttttattggttttttagatgggttttatatttttggtttaataattttgggttggatttgtaggggagttagggaggagttttgtttttggaaaggaggttgatttgatttggtgagatatgttttgtgttagaaaggtttttttaaaagtaaatttatttttgagttgagataggtgttttaggggtgaggggagtgtagaggatttattgtataatttttaaatgattgatgttgttgttgtagttttgaaaaggtttaggttttttgttttttggtagtttagtttggtgtttttgtagtttagagggagttttggtgaggggtttaaggtaaagggtgtaagggtttgggggtattggttatttgtttttgttttgtgtttttagggagtttaggattttttgattagggtatattggaagaggtttttttttaagaagtagattgatttgtatttttttgtattttataatgatgtttttttgtttttgtgtttattaattgtttgtgatttttattatgtttattttgtgagatagaattgtttaaaggttatattgtatgtggtggttttggagaatatttgaattgtttttgttgggtttttagatgttggttggttgtgtaatttttattttattgttgtttttagggaaaaaggggttagatttagtggtttatagttgttttagtttttggagttttaagttttaagtaggggtgggtatttttttaaggatttgagtatagtgggatttagatagagaattttgttgttttttaatgttatgaaatggggatatattggttttagtaggttgaatggtttttatttgttaagggtgaagggtttatgatgggttattttagggatgtggaggtagattggggttagtgattagaggtttttgtgtaattggttttttgggatgtttagggttttagtgatgtttagttttttatagggaataagattttttttgattgtttggttttattttgtttattattttggttattgtggttttttagtttgaatagtgaagttattttaggaataatgtttgttgagtaggagggtgttgggtttgggggatgagaaagatttattgtatgtatggaaattatgttttttgtggagggattgtggagtttattattttgagttgttttaataggaggaggttttatttttttgggttattgaggaagaatagtgggtttttggttttggagaatagttggatggattgttttttttgggaatatttgaggtaaaaggagggtgaggttttaagaggattatgtagagtaagaaatatttggggagaattttagtgtttggatttttttgaatataagggaagatagtttttttttagttagttttttagggtttttttattttttatagttgtttaagggtagtaggtttttttggataagggattatgtgtgtttagtggggtttatagtgattattaggatttagtttagggtatagaggtgttttgaggattgttagtggatttgtattagtggttttatattagtggttttgttaggattaggttttgttttattgggatgggaaatttgggtagatttgggatttagggtagggaggttatagggtttaggtttgaattttagtatagtatatggtagggttgagagtaaaatttagggttatgtttggatttttaggttggttattgtttttttgattttagatgttttatttgttgaatggggatatttgggaatagtatttattttatgaagttattatggagatgaaagagttaattgtttatatgggtagtgtagaatgggtgtttggtgagtgtttagggatgattttttttggtagttgttttatagaggttaatattgtttgtattgtagttattgtttttaagtttgtttggagggaagagagtaggttatgtttatttgattttgatgaattagttggtttgggttatgttttttagggagaaaatttttgagtttatagagttgtttatagatattattgtttgtgtgtaattgttgtagattattgaggtaggttagagagtagataggtgttaagtattagtgatattttgaggttatggtatgaattatagtggggttttgtttgggttagtagtgtttagagttagggttttttgttgtttgaggtgttaatatgtttgtttgtaatgtgtttgtgtatgtgtgtgtatatgtgtatgtgggtaaatatgtttgtgtatgtgtgtgttgtttttttggttaggtttggttgttttatttatgtgtgtatttagttttttattattgttatttttgaggtttagggttagtattagagtatttatggttgttttttaattgtagttttttttgtttagggtggttttgggatatatatagtggtggagggaagtgattgttgttattggattttagaatataaaagttaatattattatttaatggtttttttagtgtttttaatggtattatttttttttttttgatattttaattgggtatttttttttatgatttttggatattttagttagaggattttgtggggaaagtgttgggtatatagtaggggtttatttttttagatatgttatttaaaatttggtttatttgtttttttatgtagggtttaggggatgttgaattttagggtttagaaagagtttgggataaaaagaaattttaaggggatggttttgatttgggttgagtttatttgtgttatttaattggagttttaagttttgaggtaggatgtttagatgttttagtgtagggtttttttgattaatatttgtttttttgtatttattagtaattttatttattttatttttaaagtatatttggtttttgtatttaggagttttgtatttgtagatttagtaatagtagatggaaaatatttagaaaataaattggatggttatgtttttattgaatatgtgtagattttgtttttgttattattttttaaagaatatagtattatgattatttatgtagtatttgtattgtattatatattataaataatttagtaatggtttaatgtatatgggaggatgtgtatagtttatatgtaaatattaggttatgttatattagagatttgagtatttatggattttggtatttttggggattttagaattaattttttatggatattaagggatgattgtatatatttatttaggaaggttttttattggaggaaaggtttggtttaggatagatagggatattatttttggattattgtttatttatttatttatttattggtattattttttaggattgttttaatgatagttttagtaagtggagataagaaaaaagattggtttaaatggtatagttttgaggttttggaagatgttgtattagtatgagaatagggggttagttttttttaggatttagaaagtatattaggtaggtttggggagaggaaaggaatatggtttttttagtagttatataggtttgtagtaggatggggttggggttggggttgggattggggttggttttgtttattatttgggttttatgaggggaaaagaaagaatagggggtagaggaggagtatgggggtagtgggttgtttaaggagaaggtgttttagggaaggggtattagtttgtttttatattgttataaagaaatatttgagtttaggtaatttataaaggaaagaggtttaattgatttttagtttagggaatttatagttatggtagaaggtgaaggggaagtaggtatttttt

SEQ ID NO: 414 - DNA, 6416 bp, Artificial Sequence
  chemically treated genomic DNA (Homo sapiens)
tttttgatttatttgtgattgagggtaagaatgttttttttttagagatttggtgtttttttttgtaaaatgaggtttattttgtttttttttaagggttttagggaaattttagttagagtagtgaggtgttaggtaaattttgaggggtattttaattgttgtgtgaggttaggaggtttgaatttttttattttttttttttaggataagggtatataattggttttgttaagttttttttttgtttagatgttatggagttggatttgtttttattttattttagtagttttttggaagatttttgtttagtttttgggattttttttgggattttttggttttttgatatttttttgtttgaggaggtaaagaggttttagtttttttttattttaattattggtaggtatgatggggtgtggggtttgggggaggttagtgttggataatatatagaggtttgtaggttattgtttttttttttatatttttttttttttttttttttgttataggaaattttgagaggaggagaggtgtgttattttttttttttttatttttaattttttttttgagttttgtagtttttttttatagagtttaatttttgggggtttttttagtgtaagggggttgtttttttgtgatgttagttgtttttatgtgagttgttttttagaagggaagggagggatgtatgggttttgggtttgtgggagatatatagttgtttttatggaggtaggggattttggttaggagtttttgagggtttagtaggtgtggaaagggaatgaattattttttgtttttttttaagttgtgtgtaatttttggggtgtaggtagtaaaggtgtatagtgaggatggggtttgtaggtttgtggaggtggtagtaggtgttatagtttgttatgtgtgtgaaatgttggtgtagtgagtttatgttttgagtgatgagatttgggggttggtggagtgttatttttatttagtattgggtaagttaggtgtatggaattatttgggttgggagatgatgttttgtattttgggttaggtatgtggtttatttaggagatttggttgatttttaataatttttgttttttgtttttgtttttagagtggggtttggaggattatgagtttgtggtggaagtgtaggttgtttggtttgtgggtggagatagttgttttgttttttggaaaaattttgttaagtatgaattgtttaagagttttttagtgagtgtatgagggttgtttgggtgttgggatgttttgatttttaatttggatgttggagttttgatttttgatatttgtttatttatagtattttttgtttttagaaaaaatggtttttagttgttttgatgtatatattggtatattttatgaagattttatttaggtggggggattttttattttattgtagatttatgattttttagtattggttagtgtttttttatttttaagttttgtgttttttttttatgttgtagaaagagttaaattatagttttgtgtgattggggatagttattttttttgtttgagtattagttttttttattaaatgggggtgagaaatgtatgtggagtatttttttgtaaaaatttgagggtgggttgggtatggtggtttatgtttataattttagtattttgggaggttgaggtgggaggattatttaagtttagaagtttgagagtttgagattagtttgggtaatataatgagattttgtttttttaaaaaaaaaaaaaaaaaaaaaaaaaaggttaggaatggtggtatgagtttgtagttttaggtgtttgggaggttgaggtgggaggattatttgagtttgggaggttgaggttgtagtgagttgtgattgtgttattgtattagtatgagattttgttttaaaaagaaaaagaaaaagagaaatattttggtggtagaggggaagggaggaggttagatttgttatttttttttgtttttttttggtttagaattttttgaatgttggtagtttttttgagatttagggttttttgtagttgtggggtttaggatggaagttttggaaatgttttttttgttttttgtgttgatttggtttttattattttattaagggtatttttaaggtaaggttttgagggtattagttttagtttttttagtttttggtttttttagaagttgttttttttttgttggaatttttgagtttttttttttttgggttttttaggttagttatttttagtttattatttttttttatatttttgtttagtttatttgtttagggaggtagtaggagaaaagatgattttagtttaagttttggttttatttttatttgttgtgtgattttgggtatttttttgtttttttttggttttgaaatttttttatttggtttgtggggggaggtaatagtgggtgggatttatttgtattaagttttgtttatttatgttgtttaggatttgaggtatttgtagtatgtggtagatgtgaatgagtttaatgtgtatgtggtgatgtagggttgtaagttttatgggatgtttattgattttggtttttgtgttaaggtgaagatttggttaggtttggtttttggtttggggaagtaggaattgtttaggtttttggattttgtttggggtttttgagttttaatttagatatttagatttttttttttgtattttggtttgttggaaatttttggatttagttttgttatgtggagtaggggtagatatgtggttttaaaggtagatatgggattagttaattttttttttttgtagtttaataagttttgaaatggttataaggggttttggattttttgtagtgaagatgagtagagttgtatttgttggttggttgttttttgtttttttaaggtgagattttgggagtggtatggggggttggtttggttagagggatttttagttttgtttttaggaagttttaggaatgaggagggtattatagttttgttttttgataatttttagtttaagtttgaagttataggaagtgtttattgaaggtagaaatatagttttggtttgggtaagttttggtttgaggggggtgttatagttatgtttttaggattttttgattttaagttttttttttttttttatttttagtatggggtgtagttgtataagaattattagtaggtatagttttgttatttgtatttattttgtttgggttttttatttttggtgagtgtgtttaaggggatgggagggtgggtatgtaggttttgttttatgggtatttgggttttgttttgattttttttttttttttttatttttagagaagtgttttagataatattttggtggttatggatttttttggttatgttgggtgtgttattgagaatttttgggaggttttgagtgtggttttggaggaggtttaggtttggagggtgaggtttgttgtgtgtgtgtgtgtttgtgttggggatttattttttgggtgggatttttgaaataggagggaggaagagagggtggggggaggtttttggttgggaagaagtgttttatttttttgaggtgttgggtaatgtttttaagtatgttttgatttttttgtattttttattgttttatagaagaagataaattattgttttagtttgtttatgttagtttttggtatgagttttagtgtaggtgggtgatggttttgagttttggggtgggggttgttttaatttttttttgtatttttagtggggagtagatggtataggggttttttttttaaagtgattgtttatgtttttttttattatagttatttattgtatttaattttggttttatgggtgtattttttgtgaggagagttagtggtttattggatagtagggtttggtagatgggtaaggggtagggttgggtaatagatttagggataagagagattggggtttaggtggtagttatggtttttgggtagtaatgttgttttattttttgttttttggtagtttgtttttggtttgggagagttagtggaatttttagggttttgttttttttttgtgttatttgtagaaagtgaagtattattttattttgttggtgagtttttttgtgtttttggagttttgtaatgagatataggatttttagtaatttgttttttttattaggtttttttagaggttttttggtttttagtgtgttttttttttttttgtataagaagtgggaggttgagtgtggtggtttatatttgtaattttagtatttaggatggttaaggtgggagaatggtttgagtttaggagtttgagattagtttgggtaatatagggagattttatttttataaataatttaaaaatgagttaggtatggtggtgtatatttgtagtttagttatttaggaggttgaggtgggagtattgtttgagtttagagggttaaggttgtagtgagttatggtggtattattatattttagtttggatgatatagtgagaaaattgttttaaaaaaaaaaaaagaaagaaaaagaaaaagaaaaaagaaaagaataaaaggaaatggtggggttttggtttaggagggagttttttaagttttgggtttttttttgaatttttattttttttattgtattttagagtgaggaggagggttgtttgtattttagtatggatgatggttagatttgttttattgatttgttgtagtttgtggagttttattagttgaattgtggtattttgttgtgtttgttgtgttattgttgtatgtgggtggttttttgattaggttgtggattggtttatgttttagtttgtttttaggttgtttgttgtttttttatttatttagtggattttggggtgtggttataggggatgggatgaggagtgggagggttttgttattttagtttttttttttgtttttttgttttttttagatagaaaatagtttttattttagtttatttttgatttttttttttaagggaaggttttgggtggtttttttttttttttttagttttggaggtgttgttttagggtagggaattatgggagaagtgggggtagtttaggtggttttatgttttatattttgtatagattgagaggttagttgatttgttttgttttatattagtgataataaagattattttttgatatatttatgagttttgtttggtaaggtttggttggttgaattaagaagggaattagagttggatgtggtggtttatgtttgtaattttagtattttgggaggttaaggtaggagaattgtttgagtttaggagtttgagattagtttgggtaatatggtaagattttgtttttataaaaaataaaaaaatgagttgggtatggtggtgtgtatttgtagttttagttttttaggaggttgaggtgggaggattttttgttttttgagtttgggatgttaaggttgtagtgaattgagattgtgttgttgtatttagtttgagtgatagagtgagattttgtttggaaaaaaaaagaggggagatttggagaggtgggtatttgtggaggttttggtggaagtgttaaatggattgaggttatgttttagtttgtttggatgttttttaagggtaggagtggttatttgagagtttttagtgtttattatgtagtttgatatatagtaggtgtttagttattgttaattaagtaagtgaatagataagagattattattttagagagattttttgatagtttaagtttagagaggtaattaatagggtttgggagttggagatgagtttgatagtatgtttgttttttgttagttttggattagttgatggatagttggttttagtatgtatatagttatgtatttagttttattattaagatatagaatggttttattatttttaataagtttttgtgttttttattattagttatgtttttttttatttaaattgaaattttttttttgttttagttttgttttttttagaaagttatataaatggagtttgttagtatttagttttttgtatttggtttttatttttaatatattttttagtatttagagtgatttttttttaaatataaatttattatttttggtagggtattgtggtttatatttgtaattttagtattttgggaggttgaggtgggtggattatgaggttaggagtttgagattagtttggttaatatggtaaaattttatttttattaaaaatataaaaattagttgggtatggtggtgggtatttgtaattttagttattagggaggttgaggtaggagaatagtttgaattggggaggtagaggttgtagtgagttaaga

SEQ ID NO: 415 - DNA, 6416 bp, Artificial Sequence
  chemically treated genomic DNA (Homo sapiens)
ttttggtttattgtaatttttgtttttttggtttaagttatttttttgttttagtttttttagtagttgggattataggtgtttgttattatgtttagttaatttttgtatttttagtagagatggggttttgttatgttggttaggttggttttaaatttttgattttgtgatttgtttgttttggttttttaaagtgttgggattataggtgtgagttatagtgttttgttgggagtggtgaatttatatttgagaaaagattattttgggtgttgaaggatgtgttggagatggaagttagatgtagagggttgaatgttagtaggttttatttatatggttttttggaaggggtagaattaggatagaaaggaggttttagtttgggtaggagggagtatggttgatagtagggggtatagggatttgttgggggtgatgaggttattttgtgttttggtggtggggttggatgtataattgtgtgtatgttggggttaattatttgttagttagtttaggattagtggaggataagtatgttgttggatttatttttaatttttaggttttgttaattatttttttagatttagattgttagaaaatttttttgggatgatggttttttgtttatttatttatttaattagtaatgattgggtgtttattatgtgttaagttgtatggtgggtattggagatttttagataattatttttgtttttgaggaatatttaggtaggttgagatatggttttgatttatttgatatttttattaaggtttttataggtgtttatttttttaggttttttttttttttttttttagatagggttttattttgttatttaggttgagtgtagtggtataattttagtttattgtaattttgatattttaggtttaaggaataagggatttttttattttagttttttgagaagttgggattataggtgtatattattatgtttggtttatttttttattttttgtagggatagggttttgttatgttgtttaggttggttttaaatttttggatttaagtaatttttttattttggttttttaaagtgttgggattataggtatgagttattatgtttagttttggttttttttttgatttagttagttaggttttgttagatagaatttataggtgtattaaaaaataatttttattgttattagtataaaatagagtagattaattggttttttggtttgtataaagtgtggggtgtgaaattgtttgggttgtttttattttttttataattttttgttttagagtagtatttttagagttaggagaaggagagggggttatttaaggtttttttttgaggagaggggttaggagtggattggagtgggggttgttttttatttgagggaggtaaagaagtagaggagaaaattggagtggtggaatttttttgttttttattttgttttttgtggttgtgttttagagtttattggatgggtggaggggtggtgggtagtttgaaggtgggttgaggtatgagttagtttatggtttggttagagggttatttgtgtgtagtaatggtgtagtaagtatggtaggatgttgtggtttagttggtggaattttatgagttgtagtaggttagtgaagtgggtttggttattatttatgttgaagtataggtggtttttttttttgttttggggtatagtaaagggggtggaagtttagggaggggtttgaggtttgggaagtttttttttgggttagggttttattatttttttttattttttttttttttttttttttttttttttttttttttttttttgagatagtttttttattgtgttatttaggttggagtgtggtggtgttattatggtttattgtagttttgattttttgggtttaagtaatgtttttattttagttttttgagtagttggattataggtgtgtattattatgtttggtttatttttaaattatttgtagagatggggtttttttgtgttgtttaggttggttttgaatttttgggtttaagttatttttttattttggttgttttaagtgttgggattataggtgtgagttattgtatttagttttttattttttgtgtagggaaaagggagatgtattgggggttagggagtttttggaggggtttggtgaggaggataggttgttgggagttttgtgttttattgtaggattttggggatgtagggaagtttattggtaggatgagataatgttttattttttgtaggtggtataaagagaggataaagttttgggggttttgttgatttttttggattaggaataggttgttagaagataggagatggggtagtattattatttaaggattatggttgttatttggattttagttttttttatttttgggtttgttgtttggttttgttttttatttgtttattaagttttgttgtttaataagttgttggttttttttatgggaaatgtgtttgtggaattagagttgggtgtggtggatggttgtggtggggaaggatatgggtggttattttggggaggggatttttatattatttattttttattgggaatataaagagaagttgaggtagtttttgttttaggatttggggttgttatttatttgtattgaggtttgtgttggaggttggtatgggtaggttgaggtggtggtttgtttttttttgtggagtagtgggagatatgggagagttggggtgtgtttgggggtattatttagtattttaggaaggtagagtatttttttttagttaggggtttttttttgtttttttttttttttttttattttagggattttatttagagagtgggtttttagtataaatatatatatatatagtaggttttattttttaggtttgggttttttttagggttatatttagagttttttgggggtttttaatgatatgtttagtatggttagagaagtttatggttattagggtattatttgaggtatttttttggagatggaaggagaggagagaggttagaatagggtttaggtatttgtaagatagggtttgtatatttatttttttatttttttgggtatatttattaagggtggggagtttaaataagatggatgtagatggtgagattgtgtttgttggtaatttttgtatagttgtattttgtattgggggtggggagagaaagagagtttgaggttgagaggttttgggggtgtggttgtgatgttttttttagattaggatttgtttagattagggttgtgtttttgtttttgatgggtattttttataattttaggtttggattgggggttattagagagtaaggttgtgatgttttttttatttttgagattttttgagggtagagttggggatttttttggttaggttagttttttatgttatttttagggttttattttgaagaggtggaaggtagttagttagtaggtgtggttttgtttatttttattgtagaagatttgaagttttttgtggttattttgaagtttgttgggttgtagagagaggaaattgattggttttatatttgtttttaggattatatgtttgtttttgttttatatagtagagttgaatttaggagtttttagtaggttagggtgtagggagaggagtttaggtgtttgaattggggtttagaagttttgggtaggatttaggggtttgagtagtttttgtttttttaggttaggggttaggtttggttaggtttttattttgatatagaaattgaagttagtgggtattttgtagagtttgtggttttgtgttattatgtatatgttggatttgtttatatttgttatgtattgtaggtgttttggattttaagtagtatgagtgagtaggatttggtataggtagattttgtttattattatttttttttataagttaggtggggagattttaggattagagaggggtaggggaatatttagggttatatagtaaatagaagtagagttaggatttaaattaagattatttttttttttgttatttttttgggtaggtgagttaggtaaggatgtagggagagatggtaaattggaggtggttggtttggggggtttagggggagaagggtttagaggttttagtagagaaggggtaatttttaaaaggattagggattggaggggttggggttggtatttttaagattttattttagaggtgtttttggtggagtaatagaggttagattggtgtaagaagtagaaaaagtgtttttaaagtttttgttttgaattttgtagttgtagaaagttttggattttaggaaagttgttagtatttaggaagttttgagttagaggagagtagaggagagtgataggtttgattttttttttttttttttattattaggatgtttttttttttttttttttttttgagatagggttttatgttagtgtggtggtatgattatagtttattgtaattttgattttttgagtttaagtgatttttttattttagttttttaagtatttgggattataggtttatgttattatttttggttttttttttttttttttttttttttttggagagatgaggttttattatgttgtttaggttggttttaaatttttaaatttttaggtttaagtaatttttttgttttagttttttaaagtgttgggattataggtatgagttattgtgtttagtttatttttaggtttttataaggaaatgttttatatgtattttttgtttttatttaatagaagaaattgatgtttaggtagggaaagtgattgtttttagttatataggattgtgatttggttttttttataatatagaggggaggtataggatttaagggtggagaagtattggttaatgttggggagttgtgaatttgtagtgaaatggggggtttttttatttggatgaggtttttatgggatatattagtgtgtgtattgagatagttggagattattttttttgggaatagggagtgttgtgggtagataagtgttagggattagggttttagtatttaggttgaggattagggtattttagtgtttagatagtttttatgtatttattggggagtttttgaatagtttgtatttggtgaagtttttttggaagatgaagtggttatttttgtttatgggttaggtagtttgtatttttattatggatttgtggttttttaaattttgttttggggataagggtaaaaagtaggggttattggagattaattagattttttggatgagttatatgtttagtttaagatgtaaggtattattttttagtttggatagttttatgtatttgatttatttagtgttaggtgggggtggtattttattagtttttaggttttgttgtttaaggtgtgagtttgttgtattagtattttatatatgtggtgagttgtggtatttgttgttatttttatagatttgtaggttttatttttattgtatatttttattatttgtgttttaggaattgtatatgatttgaggggaggtaaagggtgatttattttttttttgtatttgttagatttttagggatttttaattaagattttttgtttttatggaagtggttgtgtattttttatagatttagaatttgtgtatttttttttttttttttgagggataatttatatgggggtggttggtattgtgggggagtagtttttttgtattggaggggtttttgagaattgggttttgtgagggaggattgtagagtttagggaaggggttggggatagaggggagggaggtggtatgttttttttttttttgaagttttttgtggtaagaagaaaaagggagagaggtgtggggaagggagtagtggtttgtaagtttttgtgtattatttagtattgattttttttaagttttatgttttattgtatttgttggtggttgggatgaggagaggttgggatttttttatttttttaggtagaggggtattagggggttggggagttttaggaggggttttaggggttgggtaaaggttttttggagagttgttaagatgaggtggagatagatttagttttatggtgtttgagtaagagaggggtttaatggaattagttgtgtgtttttgttttggggagaggggatgagagaatttagattttttgattttatatggtggttagggtgttttttagagtttatttagtattttattgttttaattggagtttttttgaagtttttggggaaggatagaatgagttttattttataaaaggggatattgagtttttgagaagaaagtatttttgtttttagttataggtgagttgggag

SEQ ID NO: 416 - DNA, 6001 bp, Artificial Sequence
  chemically treated genomic DNA (Homo sapiens)
ttttaatattagaaggaataaattttgaatatattatttttaagaattgtaatatttattgtgagggtttatggttttatttttgaagttagtgagattaagaatttattaattttggatataaggtgataggttgagggtggtggtttggttttgggtttttttggggtttttttagggaatgttttggtatttgttgattgagttttgggaggtagttttggtatatagttttttgatatgatttgttttttattttggggtgttatatatgaagggaggtgattgttgtgatggtgttggtaggattgttgtttttgatgtggggtgggttgagttaggtttgaaatatgggtttttaggttgagttttgttttttttattatatttagggttgattgatatttttagttagtttattttggttttttttttatatgttaggataatgtagtttttgttattaatttgggtagttagagttgggttagtgggggatatgggattatgggtaagggtaattgatatttgtttagttttaatgtatttgttttaaatgtggttaggtggtggggtaagtaggaatgaggtaggggtggggttgttttgaggaggatgattttaatgagggtgtgagtaggggatttaagttggaattattatattgttttattgtatattagagtttttggttagggagtaggttggggattaggtattttattttagtggggtatagtataaagtttgtagggggatggggttattagaaagttgatgatatgagagtggttgggttggggttgtttggtggttatggagaagttgaagtgttgtagtagggaggtgaagaagaggaagagttttatgtgggttaggggttttttgaggtatgtatggtggtttgtggggaggggaggggtgttagtgagtttggtttttgggtgatatttttgtaagattttatggaaggggatagggagttgggttttttataggtatttgttgagaaaggtaggaaggtttttggttttataaagtggttttgggtatttaggaagtgtttggggtggaagtggaagggttttttttagatggttttattttttagtattgatgataggttggtgatgagtgttgttttttgggtaggagatgtagggtgagagtggggattggattttaggatgttgggatttttgttattaaatatatgggggatatatattgtttggtatatagttggattttgttaattagttttgtgtttgagaagttttatagtattttttttgattttatagtagggtgtagttatattttttagaggtatttatattgttttttttttttgtaggtgttgggttttttaatattttggtaggttttgatttgttttttttattagattggggttttggatggataggttagttttgtttatattttggattttttatttaagtggggatagttagtgtggtggtattgaggattaggtggttagggtttttagagtgggtttatttggtagtagttatgttggggttattattaggggttggtgttgagttggggtgaggagggtgttaggtttattttagggatgtggaagttttgtattttgatgttatgggatgttatatgggttatatttagggggatgatgtttttaaagtgttgtattttgtgaattatggtagtggtgtagggtatgtgagtttggttatttatttttggttgttgtatttgttttattatgttgttgattttttgttggatatggattggatagatatgtgtttttataatgggttagtatttaggggatattttttttttttttgtgttggaggaagttaggtttataggagtttggttatgtttgtgttggaagttttgggtgttttagttaagtttaggggtttttagttgtatttttttttttttagtttttgttttgggttttagttgggtttatgttgtatatttaggtgtaggattatgagtaggaggttttaggttagtgtggttgaggtggttattattttggtaaggaataggttatttattattatgtgtaggtttttattattgaagttgtttttagggttttttttggtttgagtagggttgagaggatatttaggggatagaatggggtagtttttaaatgatttttaattttgtatttgttagtttagatgtggtttgttgggtgatgtattggtttaattttttgtttagtttttttttattttttttgggatgtttaatttattatttttgttttttattgtggtagttatttttattttttttttttttgttaggaaggttttagttaggttttggggtggttgggttgggttttaggttattttgtgtttagttagtagtttatttagttgggttaggaaagttttttggaagtgtaggattttgttagttagtgttgggatgtgtgggaggatggggatagtatttagtatttatattagatagaatggggttttaattttttttgtgttttgtgtttatttggattagttttaggttttagttatttttaggaagatttagggtttgtttgtttttattattgattttattaagtttttttttaagtgttagtttttattttttttttttttgtttagaggagaaatttaaaattgaaatttttaatgtggatgggggtatagagtttttggttttttttggtgttttttgatttgggtatattttttttatgattatgtttgagatgttttttttttttttaggttttttttatagtggggttttttggaatgtttttttttaaatttatttatgtaaattttgttttttggaggttttagtttagttttggtattttttaggagtttgttttgtagagattttttggttttttgttttgtattttgtgtaggaagtttgattttttttttagttttttttgagttaggtttagtagtttgaggaagtgagggttgttgtatttgaagtggtgtttgtaggtgagggaggtgattatgttgtttatggttttgtttaagaggttgttggggtgaaaggggtgttttgggggtgggagatgtgggtaaggggttgttttttttgttttttgtttttttagtttttgttttgtgtttttttgtttattatttattggtttggttggtgaaggtggtataaaggtaggtggtttttttggttatttattgttttagtgattttttgtttaggtttaagttgtgtaaggtggatatggagaagtgtttttgtttgtgttatgtgggtttatagtgtgataggattatttttgggggtgggatgggtatgtgggtgttgttatgaaggttttggttttattttttgttatttattttaattttggtgttttataaggttttttgtagtttttagtttggtttagttgggtatagggtttattttttgtttatttatattgtttttttgtttggggtggggtttggttttattttgtttttgtttattttgattatttttttatttaaggaagattttgtttgttttgtttatattgagtttgtagtataggtgtggtttttgttattgttattttgatgtattagttttgtttattgggtttttggtgggtttgggtagtagttttgtttttttttagtttatagatttgtattttttttgtgtaggtggttttttggtttattgtttttagtttatttgttggtttttatttttgttttatgtttaggattttatgttttgttggtgttgtttgggttatggttattgtttatttggggtttatggaaatgtggtttttgttttttattgttgtttgttttgggaatgtggtttgaagtttaggatttggtagatgggtgtaggtgggtggttggttgtgtttttgttgtgggttattattgttttgtgtatggttgttagtttattgagtatgattattggtgtttaggttagttgtaggttgaatatgtttttgaagtggtgttgtaattgtagagggagggttagggttttttgttaagttaggattattttagattataggttttagttttatttgaattttggatgatttttggggttattaggagtgagtaggtggaaggaggagatttagttttttgattttggggtgggggtgggggttatattttttgtgatggaggaatttagtttggatgtgttatttaggtatgattttgtaagagttattaaaattgttgagaggttttagttagtattttatttttagatgatggtttatgttggtgagtagtgaggtttgaggatttatagtgtaaaaggtttgaattgggttattgtattttttttatttttgattttgtgatttaaatggtatttaggattaatttattttttatttttaaggtttttttttttggtgttagtagaagggattttgtattttataatatatgttgtttaatgggtttgtatgtttattgttaagtttagttttatttttaggtttttgttttatttttttttggtttttggaaaatttagttttttatgttatgtataaatgtttttttttaggatgttttttaaatttgttttttttttttagtttggtttttgatttagtttgtggtttaatttattatttatgtttgttggtggtggggtatttttaggatttttgttgttttttaggatttttttttttatttggttgaagtagtatggtgtgttttggaagtttatatgtagtaaggttgtttagtttgggtagtggtaggggatttggtgggtagtgtgtagtttagtgttggtgttggtgtattaggtttattaggagtaggaagatggttattattatggttaggggtattagtgtttttagttttatggttgttttattattaattgggtttttttggatatatttggtatttttattttattaggtatagaggattaggtaggatatttttggtatattgagtgtgtgattttttttttataaagggagttgatgatggtttttgttttttgttgtgagtgaatttgttgtgttgattgtgttgttagtggtagagttaggttagggtaggtatgggttgttttagaggtttttgttgttgttttttgttttaggtttttatttagggtagggtggtagaaaggtttggttggagaagttattttttttttttattttaagttttttaagtttatataggtttttgggataattagggttttagtggatttggttatttattttttagttaggtttatatattttaatgtagttataattttttttttagaatatgattttgttttttttttatttttatttgtttattttagagtgatttttagtatttttatttgttattggtatttatttggggttttagagtttttgatgatgagtggtattatgggtttggtttttttattttattttgtatttttgatatgtatagatgttatgtatatatttgatggtgtatagattttttgtttatttttagatatttgtttatttgtttatatttgtagggatatgattatatatgtagaaaattatttatataaagataatatttatatatatatagatttatattgatatttagggtatatatttttttttatatatattagttatatatatatatagatttggtattaagtattttattttttagttatgtttgaggttttttggatgggattttttttgtttagaggttgtttttggtgagttttaaagttgttatatggattttagtttagtttatattttgggttttggttgggttatgattttttgtttgtaatagggttgtttttagagtttttagttggtagtttgaaggtttttgttttagtttgtgatagtattttttagggttgtttgagggttgttattttttattgttttttggtttttatgtttttgattagaaatttggtggaaatatta

SEQ ID NO: 417 - DNA, 6001 bp, Artificial Sequence
  chemically treated genomic DNA (Homo sapiens)
taatgtttttattagatttttaattagaaatatggaggttaggaagtagtggagaatgatgatttttaggtagttttggaggatgttgttataggttggggtaagggtttttaggttattaattgggagttttgggaatagttttgttgtaaataggaagttatggtttggttagagtttagaatgtgggttgagttgggatttatgtgatagttttgaggtttattgggagtagtttttggataggagaggttttatttaggaaattttgggtatggttgggaagtggggtatttggtgttgggtttgtatgtgtgtgtgattggtgtgtgtgagagagaatgtgtgttttgagtgttagtgtgagtttgtgtatgtgtgaatattgtttttgtgtgggtgattttttgtatgtgtaattgtgtttttgtaagtgtgaataagtggataagtgtttgggagtggataagagatttgtgtattattaggtgtgtgtatagtgtttgtgtatgttaagagtgtaaggtgaagtgaagggattaggtttatgatgttatttattattaggagttttaaggttttaggtaagtgttagtgatagataagggtgttgaaggttattttggagtgggtaggtgggggtagggaaagggtaaggttatgttttggaggaggggttgtgattatattagggtgtatgagtttagttgggaggtggatggttgggtttattgagattttggttattttagaagtttgtgtgggtttggggagtttggagtggggagagggggtgatttttttgattaggtttttttattattttattttgggtaagggtttggagtaggaagtagtggtaaggatttttggagtagtttatatttgttttggtttgattttgttattggtagtatagttaatatagtaggtttatttatagtagagggtgaaggttattattagttttttttataagggaagggttatgtgtttggtgtgttgagagtgttttgtttggttttttgtgtttggtggggtgggggtgttaggtgtgtttagaggagtttagttggtagtgaggtagttatggggttagaagtattggtgtttttggttatgatagtggttatttttttgtttttggtggatttgatgtattggtattaatgttgggttgtatgttatttgttaggttttttgttattgtttgggttgggtaattttgttgtatgtggatttttagaatatattatattgttttgattaggtgagggaggaggttttggagggtggtagaggttttgaggatgttttattattagtaaatatgggtggtgggttaaattataggttggattagaagttaggttgagaaggggaagtaggtttgggggatgttttggggaaggatatttatatatggtatgaaggattggattttttaaaggttaaggaagagtagggtaagggtttggaggtggagttggatttggtagtgggtatgtaagtttattgggtaatatatgttatggagtataaagttttttttgttgatattagaaggaaaggttttgggaatggaagatgagttagttttgagtgttgtttaaattatgaaattgaggatgaagggggtgtagtgatttggtttaaattttttgtattgtgggtttttgggttttattgtttattggtatggattattatttgggaatgggatgttaattggggttttttggtaattttggtgatttttgtaaggttatatttgggtgatgtatttaaattgagtttttttattatagaaggtgtgatttttatttttgttttaggattaggaggttgggttttttttttttatttgtttatttttggtagttttgggggttgtttaaggtttaaataggattaggatttgtagtttggggtgattttggtttgataagaggttttgattttttttttgtagttgtggtgttgttttggggatgtgtttagtttgtagttggtttggatgttggtggttgtgtttaatgggttggtggttgtgtgtgaggtgatggtgatttgtggtgaggatatggttgattgtttgtttgtgtttatttattaggttttgggttttgggttgtgtttttaaggtaagtggtggtgggggatagagattgtgtttttgtgggttttgggtggatagtgattgtagtttaagtagtgttgatagggtgtggggttttggatgtgaaatagagataaaggttagtgagtgggttgaggatagtgggttaggaaattatttgtatgggggaggtgtgagtttgtgggttgggagggggtggggttattgtttagatttgttagaagtttggtgggtgaggttgatgtgttgaagtggtggtggtggggattgtgtttatgttgtgggtttagtgtgggtgggatgggtgggattttttttgagtggaaaggtggttagggtgggtagagatgaggtggggttaaattttgttttaggtaggggagtaatgtgggtgagtaaagagtgggttttgtgtttagttggattgggttagggattgtgggagattttgtggagtgttagggttggagtgggtggtggagggtggggttaaggtttttatggtaatgtttatgtgtttgttttgtttttaggggtgattttgttgtgttatgggtttgtgtggtgtgagtagaggtgtttttttgtgtttattttgtgtaatttgggtttgggtaagaagttgttggagtagtgggtgattgaggaggttgtttgtttttgtgttgtttttgttgattaagttggtgggtgatgggtagaagggtataaagtgggaattgggaaggtgggggatggagaaggtaattttttatttgtattttttatttttaggatgttttttttgttttaatggttttttggataaagttgtgagtaatgtgattgttttttttatttgtgggtgttgttttgagtatgatgatttttgtttttttaggttgttggatttagtttaggagggattgaaggaggagttgggttttttgtgtgaggtgtggagtgagagattgaggagtttttgtagggtgagtttttgagaggtgttggggttggattggggtttttgaagggtaggatttgtatagatgggtttgggaaaggatattttaggagattttattgtaagaagggtttggaggaggaggggatattttagatatggttgtgggagaggtgtgtttgggttagggggtattaggagaggttaaggattttgtatttttgtttatgttggagattttgattttaggttttttttttgggtaaggagagagagggtggaggttggtatttggggagggatttggtgaggttagtggtaaggataggtaggttttgggtttttttggagatggttggggtttgagattggtttaggtgaatgtagagtataggagggattgagattttgttttgtttggtgtaggtgttgaatgttgtttttgtttttttgtatattttagtgttggttggtaaggttttatgtttttaaaaggtttttttgatttagttggatgagttgttaattgagtataggatgatttgggatttagtttagttattttgagatttgattgaggtttttttggtaaagaaggagaaggtgagagtggttgttatggtggggggtaagggtggtgggttgaatgttttaggaggaatgaggggaggttgggtaaaaggttggattagtgtattatttggtgagttgtatttgggttgataggtgtagaattggaggttatttgggggttattttgttttattttttgagtatttttttggttttgtttaggttaaggggagttttgagagtagttttaatgatgagaatttgtgtatagtggtgggtaatttgttttttgttgggatggtgattattttgattatgttggtttggggttttttgtttatgattttatatttggatgtgtagtgtgagtttagttggggtttaaggtagggattgagggaggaagggtatagttgggggtttttgggtttagttgggatatttggggtttttagtataggtgtggttaggtttttgtaagtttaattttttttaatataggaggaaggagagtgttttttgggtgttgatttattgtggggatgtatgtttgtttagtttgtgtttaataggagattgatgatgtgatagggtaggtgtggtgattagagatgggtgattaggtttatatgttttgtattattgttgtgatttatgaggtgtagtgttttggggatattatttttttgagtgtgatttatatgatattttgtgatattgaagtatagggtttttgtatttttaaggtaggtttggtgttttttttattttagtttagtattagtttttggtgatagttttagtatggttattgttaggtgggtttattttaggaattttggttatttagtttttaatgttattatattgattgtttttgtttggatggggggtttagagtataggtagggttggtttgtttatttagagttttagtttagtggggaagataaattaggatttgttagaatgttggaggatttagtgtttgtagggagagggggtagtgtgggtgtttttgagaggtgtgattgtgttttgttgtggggttggagagggtattgtggagttttttgggtgtaggattagttgatagagtttagttgtgtgttaggtagtgtgtgttttttgtgtgtttggtggtaggggttttagtattttagagtttagtttttatttttattttgtattttttgtttagggaatgatatttattattaatttgttattggtgttgaaggatgaggttgtttggaagaagtttttttgtttttattttgaatattttttggatgtttagggttattttgtgaagttggaggtttttttgttttttttagtaggtgtttgtggggagtttggttttttgtttttttttgtggagttttgtaggggtattatttaggagttaggtttattgatgttttttttttttttataggttgttgtgtatgttttggggagtttttggtttgtatggagtttttttttttttttatttttttgttgtagtattttagtttttttgtggttgttggatagttttggtttagttatttttgtgttgttagttttttggtgattttatttttttatgagttttgtgttgtgttttgttagaatggggtatttagtttttagtttgttttttagttagaggttttaatgtataataaagtaatgtggtagttttaatttgggttttttgtttatgtttttgttgggattattttttttagggtaattttatttttgttttatttttgtttattttattgtttggttgtatttgagatgggtatgttgaggttgagtagatgttagttatttttgtttataattttatgttttttattgatttaattttgattgtttagattggtgataaggattatattgttttggtatgtggggaaggggttagaatgggttgattagaggtgttagttagttttggatgtggtggagagggtaggatttagtttggaggtttatattttaggtttaatttagtttattttatattagggatagtagttttgttagtattattataatagttatttttttttatatatgatattttaaaatggaagataaattatgttagggagttatatgttagggttattttttagggtttagttggtaggtgttagaatattttttgggaaggttttaggaaaatttaggattgagttattgtttttagtttgttattttgtgtttaaaattggtgggtttttggttttattgattttaagaatgaagttgtggatttttatggtgagtgttatagtttttaaagatggtgtgtttagagtttgttttttttgatgttaaga

SEQ ID NO: 418 - DNA, 6456 bp, Artificial Sequence
  chemically treated genomic DNA (Homo sapiens)
taagaattttaagttattatttttgtgtatgtaggtagtattagtgttagtaataataagttagtttttttggtaaatttattaaaattaaattttaaatttttgaaaaaattaatatgtttattatgtttttgttagtttagaggtttaattatttgtgggggagggtttataattatgattaattatttatgatttgaaggtatttataaaagtatttgtttttttaagaaattattaaagaattaggtttaagattgtaaaattaattttaggggtaatagtaaattataggtttggggatttaattttgataatttttttttggaaagaaaagaattgttgttaattgtttttattttttgattttgtttgagtaaatatttgtagtttttaaaatttagaatttttagtttggttaagtaagttatggggattaatggttgttttaaggtagaggtagaagagaagaaataggaaggaaataaaaagggaatgaagatttgtagtttatgagggtgatattattaataatttttttaagtattattgaattttatggtttgtgattgagagttttttttgatattttataggttaattatttttaaggatttttttggttttagagtttgtaatgtttgggtttgaatatgatttgttttataaaaaaggttaggtgaattgatttttttttgtgaagttgttttatggtaagagattattaatttgttgaaatgtaaataattttttagatatttgaagtatttttaaatttataaagtgtttttatatatgttattttattttatttttatgattttaataggtaggtgttattattattttaatatgtaaaaataattttagaaaataatgtttttgtttttagtttataagaatatttttttgaaatttatagtatagaatttaagttatgggttagttagaaatgtttagaaatatattaattttaggaggataaattaagagaataggatggattagataaaatttataagtataatggtagaaagtgtgtttttggtataagaatggtgtaagttttgtaaataatagtgttatataggggtgtttttgtagtatttttatgtttggaaggatattatttatttatatatatgataagtatttttaattggatattttataggtaatagataaaataaaataagaatttttgttttaaaattgtagtggtggaatttattttttgggatgtattaggtgatttttttaggatgatagttgagttatagggggttaaatatattttttttttttttttttaatattataaagagttttaaaaatggattttgttgtttttaataaataaaatatatatgaaaaaaagttatttataggtttttatatataattttattttttaaaatatttatttttttttattagttaggttgaggtataatgtggttttaattttataattatttattgttttatttatatatttatgattttttgatgttttttagtttgagtttaaattgtgttgggaataaagtattgtataaattattagtttgggataagaggagataagttaaaattttttaagaagattttgtagatatttggtttttttgagtttgtagagagtttggtattttaaaggttagttttgggtttttttattttgatgattaatgttaaattgtttgattttttataaaaatatttagttgtgtttatttatattattttatttttagtgtatatagtaggtatgtatttgttgaatagaagttttaaatggatgagaaaaaagatatttttgttatatatttttttaagattgagaaaggtaaaattataatttaatttgtagaagtttttaggtatttttttttaatgtaaagttatgtatttttgtttaaaaaagaaaaggatgatataattaaataatgttaattatataatggggaaattttaggattattaagaaaatattattattttaagttatatatttttatttaatattggttattatataggagagagtaagaattgttgtttttttatttatttgtataatttatttgggaaaagtatgggtagaatatttatgatttaattatattatattttggatttatatttaattttttggagaattagtttaaagagtatgtttgtttagagatataaagtaaaatagatatagggataatagttttggaagaaatttttatgatgttgtttgagattgggtattagtatttaaattttttagattattaggagttatttttattatgtaattttaataaagagaaattgagagtatgattggtaaaaatattatgatgtttttgtattttgttaatttgatttatatttggttttatttataaagtttttattgattattatatggtatttttattttttagttttatttattttgttttttaaaaattttttaatggtatggttatgaaaaatatgtgggggttagtggggtatgttttaggttggtttattttgtttttaaaatgtatttattttttttagatttttttttagggtgggtagggagaaaatgtttttaagttgtatagttgtagggaagtttgtttaggttatgtttttttgatttgttttttggtttgttgtttggtaaggttattggttttggtttgtggttttgttgataaaatttaatttttattttgtaagattaataggttgtgtaggatttttttagttgttttttgttttgtatttttttgggtttgaggatttttggtttggttttttttgtgtgtgtgaggttttagatggtgagggtgtagttttttggtttatttgattatgttggggtgtttgaaggtttttaggtgttttagtattgttattttgtggatggtggagagtggtatgttttttttgttggtttgtatttgtatgtgttttaatgttatgaaatggtttttgttttttaagttgtgggttttgaatatttttttataggtgttttttttgatttttgttatgtatttgtattgttggttagtgtggtataggttgtttttttttatgttgtttggatgttgtttgttgtggtgttgttggggtgggtggggggtgtgtttaattagttggtggttgttgtttgtttattttggggttttttggagattggtttagttttatttgttttttgttggtttaggtgtttgggtgttggggtttttgttgttgtagaagttggatggagagatttttttgtggggttggtgtaattttggtgttgttgttgtgaaattttgtttgtagagttgttgttgttgttgttgttggaggagtgagttgatttttttttttttttttttgaagtgaagtttttaatatagatatgattatatagtttttgtttaagtgtgttttagtttagaattattgtatttaaaggaggagatgggaggataagaagaaagtgtaattagatagtttagaagttttttttggggtttttttagattttttttttttttttttatgaagtttttattgttattttttgtgtgtttttgtttttttttaagttgtttaattttttttggtttttttgagaaaagtgaagttatttttttttttttgtagggttgaagttgtttttgtgtggagaggttgtaggggttttttggggatgagtgagtggtgtgggatgtagtggaatgggagggggtgtgttgagtagtttagagtgtgttgggagtgtgggggaggggaggtgttgggtatgttaatgttatggtttaatatttatttttatattattgtgttgtgttgttattttttttgttttttgaggtttggatgtgtagggagatggggtttaggggtgttggagggtgtttaggggttgtgtataagttggagtggaaggattgtgggtttatttgtgtggggttgtagaatgtgggtgggggtttttaggattttgtaatttgatgttgggagtgtgtgagaaggggtggttagatatttgtttagaaattgttttttttttttttatttttagtttttttatgaggagatatttaaaaatgatttgtatatataaatggtttttttggggtaaaggagttttggttggaaatggaattttttttttggttgggaggatttttttggtggaaattttgggaagattagttatttggttggggagggttggggtttattgggggtgggtgagtgagtggttttgggggaggggagatattgttttttatgggattttaagggtgggagaaaggggtgtttgttataattttgtttgttgtttttttaaagaataattttaggaaggggatagtataattgtgttttgtttttaagttttaaattgattttgatttgagtaaaatttaattttttttttaaagggtggggggtggggggttaaattttgtgtttttaggggtgagagagaaggtttttgtttttggggtttggatttgtgaatttttttttatttttaggatttttttgttgtaggtagtagaggtggttgttttattttttttttggttaaaggtttggtttagtttgtagttggatgtttttggagttttttgtataataaagtgttagagtagggtattttaattttttttttttatttagtagttatttgggatttagggggttttttttttttagggttgttgtggttttggtaggatttttattatgatggttgtatgtttggaatttttggggtattttggaattatttgttttgtaattgttggtttgtttgttttttgttaggaattaaataaatggtgtgatttttatgatgagtgggtggagtggattgtggtgagagtagagtttttggtatttattatatttagaattttttttaaaagttgaggaaagagtttttagggattgtttgggggtttgagttaggttgagggttatataggtagttggggagttgttgttggttgtttaatttgtttgttttgtatttttttaatttttttttgtttgagtttagttttgggttttgtagtgaaggaagtgttggggatgttttatttttgtagggaattgtgtttgttgtttttgttgggttttgtattgttttggttttttttttatttgttttttagatggttggttttggtggagagaaatgggagtagtaatgtttttttttttttttttttttatttttttttgttgttgttgttgtttttttatgttggttgaatgtgatttgattttattttaaaaaaagtttgatatagtgttttaatatttttgtatttttttgtgattataaaggttgtagttgtttttttttgttttttgtttttgttttttgtttttatatttaatgaaattttttatgtgttttttttgaagtttgttaagtattataagggttgttattagtatagtgataagaggttatattggggattgtgatttttgtgtgtgtgtatatgtagatgtgtttatatgtatatggatgggtgtgttgtggggattagggttgtttattgtggggtgtgtgtttaattttaatattttaaattataaaagtaaatttggaaattatagtaaatgtgtgtttttgtggggttttaagtttgggtattggttggttgtgtgtatttttttgtgtataatatgtttgtaggaagtttgtgttaatatttattttgtggaggggaaggtggagtttatatttatattttagtgagttggagagggagtttttgagggggaaatgtaagtatattttttagtatggagtttttagaggtagtgtattttaaattttaaatgtgaattattatgtgagtgtttgagtagagttttagttttgtttggagaaattgtatgaggtgtgttttgtgtgggtgtgtgtgtgtatggatatgtggaagtaggattttggtgttgtgggtgtttttaggttgggattttttttttttattagataaggagaattttttagttttttaaaattggtttttataattaattttgttttagtttgtaaggggttaattaaagttgattttaaggaaatataggttttttttattttttgttattttttatttattttatttatagttttgttttggattttggttaattttttagattttttttgggattttttattttgtagtttatttatttgagtgtatagttttttatttgaggggtttagttgtgttgggttttttgagggggttgtgagtgttagttggttttttgtatgtgtttgtggttttgtggagtaggtaattagattttggggaaggagttattagtattttttttggtgagggggtgggtatagtggtggagggtggagggatggtggagggtgttgtttgtgttgtttgttgggggtggatgggggttgtt

SEQ ID NO: 419 - DNA, 6456 bp, Artificial Sequence
  chemically treated genomic DNA (Homo sapiens)
agtggtttttgtttgtttttagtgagtggtgtgggtggtgttttttgttgtttttttgttttttgttgttgtgtttatttttttgttggagagagtgttggtaattttttttttagagtttgattatttgttttgtgaggttgtggatatgtgtggagagttgattgatatttgtagtttttttgggaggtttgatgtgattgggttttttaggtgaggagttgtgtgtttgggtgggtgggttgtggggtggggggttttgggggagatttgggggattggttggggtttgaggtagaattgtgggtggggtaagtggagggtggtggggggtgggggggatttgtgtttttttggaattggttttggttaattttttatgaattgagatgggattggttatgggggttagttttggggagttagaggattttttttatttgatgagagggggagattttagtttagggatatttgtgatattgagattttgtttttatgtatttgtatgtatatatatttatatggaatatgttttatatagtttttttaaatggaattggaattttatttggatatttatataataatttatatttagggtttaaaatgtattgtttttagggattttatgttggagaatgtgtttgtattttttttttgaaaattttttttttagtttgttgaggtgtgggtgtgggttttatttttttttttatgagataaatgttaatgtaggttttttgtgggtgtgttatatatagaaaagtgtatgtagttggttagtgtttaggtttggagttttgtgaagatgtatgtttgttgtagtttttaagtttatttttataatttaaaatattggagttaaatatatgttttgtagtgagtagttttggtttttgtagtgtgtttgtttgtgtgtatatgggtgtatttgtgtgtgtgtatatgtgggagttgtggtttttggtgtggttttttgttgttgtgttggtggtgatttttgtggtgtttggtaggttttgggagaggtgtatgaaggattttattgagtgtgaagatagagagtagagatagaaagtagaaggaggtggttgtagtttttgtagttgtggaggaatgtggaaatgttgaagtattatgttaaattttttttgaaatggggttaagttatatttagttagtgtgggaaagtaataataataataaaaaaaagtggaggagagggggggaaaaggtattgttgtttttgtttttttttgttgaagttgattgtttggggggtgagtggggggagagttagggtagtgtggggtttggtgggggtagtaggtgtagttttttgtgggggtgggatgtttttgatgttttttttgttgtggagtttggggttagatttgagtgggagggggttggggggatgtaggataggtgggttgggtggttggtggtggttttttggttatttgtgtggtttttgatttggtttagatttttgggtagtttttgggggttttttttttggtttttaaggaaagttttgaatgtagtgagtgttagaagttttgtttttgttgtggtttgttttatttgtttattgtgggggttgtgttgtttgtttaatttttggtaaaaggtgagtgggttagtggttgtgaggtaggtaattttgaggtgttttgggaattttggatatgtggttgttgtggtgaaagttttgttgaggttgtggtggttttggaggagggaggttttttaggttttagatagttgttgaatggggagggaaagttagggtattttattttggtgttttgttgtgtagagggttttgggggtgtttggttgtagattggattgggtttttagttggagggggaatggggtagttatttttgttatttatagtggggaggttttgggaatgggaaaaggtttgtgagtttgggttttgaggatagagatttttttttttatttttggaggtgtaggatttaattttttattttttattttttgaaagggaggttgagttttgtttaggttgaaattagtttaaaatttaaggatgaggtgtgattatgttattttttttttgaagttattttttaaggagatgataagtgaaattgtggtgaatattttttttttttatttttgggattttgtgggggatggtgtttttttttttttaggattgtttgtttgtttatttttgataagttttaattttttttgattagatggttggtttttttaaggtttttattagggaggtttttttagttggagagagaattttgtttttaattgagatttttttattttaaaaagattatttgtgtatgtgagttgtttttaaatgtttttttgtagaaaaattgaaagtagaaagaaaggaagtaatttttgagtagatgtttgattatttttttttgtatatttttagtattgggttatagggttttgggagtttttatttatattttgtggttttatatggatggatttatagtttttttgttttagtttgtgtgtgatttttgaatgttttttggtatttttggattttgtttttttgtatgtttgggttttaggaggtggggagggtagtggtgtaatataatgatatagggataaatattaagttgtgatattgatgtgtttggtgtttttttttttttgtgtttttggtatattttgggttgtttggtatgtttttttttgttttattgtgttttgtgttgtttgtttatttttgaggggtttttgtaatttttttgtgtgaagatggttttagttttgtagggaaagaaaagtaattttgttttttttggaggaattaggaaggattaagtggtttgggagagggtaggagtgtgtggagggtagtgatggaggttttgtaaaggaggaggaggggagtttggaggaattttgaggaaggtttttgggttgtttgattgtattttttttttatttttttgtttttttttttaggtgtaatgattttggattgagatgtgtttgggtagaggttatgtaattgtgtttgtgttgaggattttgttttgaggagggaagaggagggattggtttgtttttttggtggtggtggtggtggtgattttgtaggtggagttttgtggtggtggtattagggttatgttagttttgtggggaggtttttttatttagtttttgtagtggtgaaagttttagtgtttgagtgtttgagttggtggggagtaagtaaagttagattgatttttggggagttttggagtaggtgagtggtggttgttagttagttgagtgtattttttgtttgttttagtggtgttgtggtgggtggtgtttaggtggtatggagaaggatggtttgtgttgtgttgattagtagtatgaatgtgtggtggagattggggagggtgtttatgggaaggtgtttaaggtttgtgatttgaagaatggaggttgttttgtggtgttgaagtgtgtgtgggtgtagattggtgaggagggtatgttgttttttattatttgtgaggtggtggtgttgaggtatttggagatttttgagtattttaatgtggttaggtgagttagggagttgtgtttttgttatttggggttttgtgtgtgtggggagggttgagttgggaatttttaggtttagaaaggtgtggggtagagggtgattggggaggttttgtgtgatttgttggttttatagagtgagagttaagttttgttgatagagttgtgagttagagttggtgattttgttagatagtgagttgaaagataagttaaaaaaatatgatttgagtaggtttttttgtagttgtgtaatttagaagtgttttttttttgtttattttgaaggagggtttgggggaagtgggtgtgttttagggataggataagttaatttgagatatgttttgttagtttttgtatattttttgtggttatgttgttggggaatttttgaaagatagagtaggtgagattggagaatgaggatgttgtgtgataattagtgggaattttatgggtggagttaagtgtaaattaggttaataagatgtagaaatattataatatttttgttagttatatttttagtttttttttattaaagttgtgtagtaagaatgatttttggtggtttaaggagtttgagtgttgatgtttaattttaaatagtgttataaaaattttttttaaaattgttatttttgtgtttgttttattttatatttttgggtggatatattttttagattaattttttaaagggttaaatgtgagtttaagatgtggtatggttagattataaatgttttgtttatgttttttttagatggattgtgtgagtgggtggggagatagtagtttttatttttttttgtgtggtaattagtattaaatgaaaatgtgtgatttaggataatggtgtttttttagtgattttggaatttttttattgtgtggttgatattgtttggttgtgttattttttttttttttaaatagagatgtatagttttatattgaaaaggaatgtttagaaatttttgtaaattgggttgtgattttattttttttgattttgagaaaatgtgtagtagaaatatttttttttttatttatttagggtttttgtttaataaatatatgtttattgtgtgtgttgaggatgaaatgatgtaaataagtatagttaaatatttttgtaaaaagttaaataatttaatattagttattaaagtggagagatttaagattgatttttgaaatattaaattttttatagatttagagagattaaatatttatagaatttttttgggaggttttaatttgtttttttttattttaggttggtgatttgtgtggtgttttgtttttaatgtagtttagatttaagttagaaggtattaaagaattataaatatataaataaggtagtaaatggttataaagttaagattgtattatattttggtttagttagtgaaggagaatgagtgttttagaagatgagattatatataaaaatttatagatgatttttttttatgtgtattttatttgttaaaaataataaaatttgtttttggggttttttgtgatattggagggaaaaggggagggtatatttagttttttgtaatttagttgttgttttaggggaattatttaatatattttgaaggatgaattttattattataattttaagatggaagtttttgttttattttgtttgttatttatggagtatttagttaagggtgtttattatgtatatgaatgaatagtgtttttttaaatgtagaggtattatagaggtatttttgtataatattattgtttataaagtttatgttatttttatattagaggtatattttttgttattgtgtttgtagattttgtttgatttattttatttttttgatttatttttttgagattgatgtgtttttagatgtttttaattgatttatgatttggattttgtattgtgaattttaggaggatatttttatgaattgaagataaaggtattgttttttaaaattatttttatgtgttaaggtgatgatggtatttatttgttaaagttgtgagaataaaatgagatggtgtatgtgaaagtattttgtaaatttgaaagtattttagatatttaaaggattgtttgtgttttagtagattgatggttttttgttatggagtagttttatagggaggggttaatttatttgattttttttgtagaataaattatatttaaatttagatattataggttttggaattaagaagatttttgaggataattagtttgtaagatgttagaaaagatttttagttatgagttatgaaatttagtgatatttgaggaaattattgatgatgttatttttatgagttatagatttttattttttttttgttttttttttgtttttttttttttgtttttgttttgaaataattattggtttttatgatttgtttggttagattaagaattttggattttagaggttgtgaatatttgtttagatagggttaggaaataaggatagttgatagtaatttttttttttttaagggagagttgttaaagttgggtttttaaatttgtgatttattattgtttttgggattagttttatagttttaagtttggttttttaatggttttttaaaagggtagatgtttttataagtatttttaagttataagtaattgattataattataggtttttttttatagatagttaagtttttaagttaataggagtataataaatatattagtttttttaaaagtttaagatttaattttgatggatttgttagaaaagttgatttgttattgttggtattggtattgtttgtatgtatagggataatgatttgaaatttttg

SEQ ID NO: 420 - DNA, 4499 bp, Artificial Sequence
  chemically treated genomic DNA (Homo sapiens)
tttagaggttattatttgaattttggttaattgtgaggaaaggttggaagaggagtttggagatggattgtggtaattttggaagatttatgttttggaatttgagagaaagagaggaggttatattatttaggagagaggggttgttgaggtggggtgagttggaatttgtttttataagttatttttgttttttggtttttagggatttgggggtttttggtttttttttttattttggtttaggattaagtttttttttaatttttttttttgtatgtggatttttagatttagtttggtgttttagttagagtttaggttatagtggggagtgtgagtgaggagtatgttttttgatgggttttttagtgagggttgaaaggtagatgttgaaaaggtgatttgtttagatttatgggattagttggggtagttttgggatttttagagtttttaaagatgatggtttaaaaattaggagtagtgtgagtggttgttgagttttattttatttgtaagtttttgttaagtattgggtaggaaatatgatagttaagaggattggagtgttgatttttttttttgggagtgatatttgggatagtttttaaggttgaagggtttaggttttttttgttgtttttatttggggatgttttttttggttttttgttgttgtgtatatgtattagttgggtagtaggagattagttaatgagattgtaaatgttgtttgtttttatttatttatttttgagattgagttttgttttgttgtttaggttggagtgtagtggtgtgattttgatttattgtaagttttgtttttagggtatatgttatttttttgttttagttttttgagtagttgggattataggtgtttgttattatgtttggttaatttttttttatttttagtagagatggggttttattgtgttagtgaggatggttttgattttttgattttgttatttgttttttttggttttttaaagtgttgagattataggtgtgagttattgtgtttggtttgttgtttgtttttagttattgattgttaaaagattaagttgttggtaagttgatattaataatttttttggaaaaattttttaattaagttaataatagaaaaatattggttgtaattgtagatattagttattttgaagatgtgtgagagggaggtatagtgggttttgggtaggttgtaggggtgtgtgtgtgtgaatgtgttgggtttgggagattgagagtgtgtgtgtaagattttgggagggagttttttttttggggtgaggagtgtggattgtagtttttttaggttagtttttgtttaatattttttataatttttaatttttaagttttgtatatttgttttgttttaggttggatagttatttttagggatttttttttttgttttatttagaaggaggtagttgtgagttgggtgtggtggtgggtgtttgtaattttagttattagggaggttgaggtaggagaattgtttgaatttgggaggtggaggttgtagtgatttaaaattgtgttaatgtattttattttgggtgatagattgagattttgttttaaaaataaataaataaataaatgaagttgttgtgagtgtttttttttttttttttttttgattagttgagttgtattgattaaggattatttggtttgggtggtgggatagggagggtttgggtgagttttttttggagttttggagtttgtaggagatttgtgggggtgggttgtgtttttaagagagtgagtgtttttaagagagtgagttttttgttatgggtggtgtttataaaatgtgtttttgtgggtgatagaggggtgtggtggggtttaggaggtttgtgggtgattttgagtattgggttggttttgagtgaggggttagttttggggttgggaggaaggtgagaggtagtgttattgtttttgattttttgggtgattttatgaaggaaggtagagggttgagttttagtgtggattagttaaatttgatgggtttttgttggttatttgtttttaattttggttgggttgggaggggtttttttgtaagtttttttgtttggtggaggttttttttttttaatttttgtgatgggtgtatgttttaagttgtttttgtttgttgggtttgtttgttgtttttagggtttggtggtttgtggtggtttgtgtttattgtgttggttttattgattttgattaatgtaggtttgagatgtggtggtttttgttgagtgggtgtggtgtttggggttttttgggagtaggtgtgaaggatgtgtttggagtttgttgtttggatttttggtttttgggtgtgtagtaattttttgtggtaggattgtaattgtggaggtttgtagttgtgattaaatttgtgttttttttgttggttttgtggtttgtagtttatttgggttaatggtgttaattttggattttttttaatgttgggttttgtggtatttgggaaagtttttatgtaggaaggtttagggttttgtgggtgtatatatgggaaggtataaaagttatagatattgtttgtttaaattgaagtttggtggaaagttatgtttttttattttttaaaaaatttaattttgttgaagtatagtttatatgtaataaaatgtatttattttaagtggatatttagatatatattttgatatagttatattttattattatgattaagatatagaatatttttatgtttttaaaaattattttgtgttgttattttagattattttgtgtttttttatttattttattttatatatttgagttttaggtaattgttggattgtttttttttattatagattatgtttttgtattttttggagttttatattaatggaattatatattatgagttttgtgtttgatttttatttagtttaatgttgttgagatttttttttattgttggaaagattagtagtttatttttttgtgtgtgagatggagttttgttttgttgtttaggttggagtgtagtggtgtgattttagtttattgtaatttttgttttttgggtttaagtgatttttgtgttttagttttttgagtagttgagattataggtatttgttattatatttggttaatttttgtatttttttaatagagatggggttttattatgttggttaggttggttttgaatttttgattttaggtgatttatttattttggtttttttaagtgttgggattataggtgtgagttattgtgtttagtttttttattgttgatattgtattgtttggttgtattgtaatttgtttaattttttttttgtttatagatatttggatttttttttagtttgggttattttgaattaagttgttaggaatatttgtttaattttgtgtgattttatgattttattttttttgggtgtatatatagaaatggaattggtgggttatattagaaaatatatttttaatgttgtaagaaattgtaaaattattttttaaagtggttgaagtattttatatttttattaatagtatatgaaagttttagttatttttatatagttattaatttttagtattgttagtttttttaattttagttatgttagtgggtgtttagtggtattttattgtatttttaaattttattttttaaataattatgttgagtattttatgatgtgtttgttttaaaaatgtgtatattttatttagtgtaatgtttgtttaaatattttatttatttttattaggttatttgttttatattattgagttgtaaaagttttttatatatttaggatataatttttttatttatgttttgtatatatttttttatagtttgtggtttgttttattattttttttttttttttttttttttttttttttttttttttttgagatggagttttatttttgttgtttaggttggagtgtaatggtgtgattttagtttattataatttttgttttttaggtttaagtgatttttttgttttagttttttaagtagttgggattatggttatatattattatgtttggttgattttgtatttttagtagagatggggtttttttatgttggttaggttggttttgaatatttgattttaggtgatttgtttgttttggtttattaaagtgttgggattataggtatgaagtattatatttaggtttttttgttttgttttgttttgtttttgtttttgtttttttaagatagagttttgttttgttatttaggttggagggtagtggtatgattttaggttattgtaatttttattttttgggtttaagtgatttttttgttttggtttttttagtagttgagattataggtgtgtgttattatgtttggttaatttttgtgttttttagtagaaatggggttttgttatgttggttaggttggttttgaatttttgatt

SEQ ID NO: 421 - DNA, 4499 bp, Artificial Sequence
  chemically treated genomic DNA (Homo sapiens)
ggttagaagtttgagattagtttggttaatatgataaaattttatttttattaaaaaatataaaaattagttaggtatggtggtgtatgtttataattttagttattggggaggttaaggtaggagaattgtttgaatttaggaggtggaggttgtagtgatttgagattatgttattgttttttagtttgggtgatagagtaagattttattttgaaaaaataaaaataaaaataaaataaaataaaataaaaaagtttgggtgtggtgttttatgtttgtaattttagtattttggtaggttaaggtgggtggattatttgaggttaagtgtttaagattagtttgattaatatggagaaattttatttttattaaaaatataaaattagttgggtatggtggtgtgtgattataattttagttatttgggaggttgaggtaggagaattgtttgaatttgggaggtggaggttgtggtgagttgagattatattattgtattttagtttgggtaataagagtgaaattttgttttaaaaaaaaaaaaaaaaaaaaaaaaagagagagaaaaagaaaatgatgaggtaagttatagattgtgagaaaatatatgtaaaatataaataagggagttatattttaaatatatagaaaatttttatagtttagtaatataaaataaataatttgataaaaatgagtgaaatatttgaatagatattgtattaaataagatatatatatttttaaaatgaatatgttataagatgtttaatgtagttatttgagaaatgaaatttaaaaatatagtaaggtattattgggtatttattagtataattaaaattaaaaagattggtaatattaaaaattggtggttatgtggagatgattggagtttttatatattattggtgggagtgtaaaatgttttagttattttagaaaatagttttgtagttttttataatattaaaaatatattttttgatatgatttattaattttatttttatatatgtatttaagagaaatgaaattataaagttatatagaattgaataaatatttttaatagtttaatttaaaatagtttaaattgggaaaaagtttaaatgtttatggataagagaaaggttaaataaattgtggtataattagataatgtaatattagtaataaaaaagttgggtgtggtggtttatatttgtaattttagtatttagggaggttgaggtgggtggattatttgaggttagaagtttgagattagtttggttaatatggtgaaattttgtttttattaaagaaatataaaaattagttgggtgtgatggtggatgtttgtaattttagttatttgggaggttgaggtatgagaattgtttgaatttaggaggtggaggttgtagtgagttgagattgtgttattgtattttagtttgggtgatagagtgagattttattttatatataaaaaggtaaattattgatttttttaataatagggaggggttttaataatattaagttaagtgaaagttagatatagagtttatagtgtatgattttattgatatgaaattttagaaaatataaaaatataatttatagtagaagaaagtagtttggtggttgtttagaatttaggtgtgtgggatggggtgagtagagggatatagggtagtttgggatgatagtataaggtaatttttgaggatatggaaatgttttgtattttgattatggtagtggagtgtgattgtgttaaaatatgtatttaaatatttatttaaagtgggtgtattttattgtatgtaaattgtattttaataaagttgaattttttaaaaagtaagaaggtatagttttttattgagttttaatttgaataaataatatttgtagtttttgtgtttttttatgtgtatatttgtaggattttgggtttttttgtgtggagatttttttgggtgttatagggtttggtattgagaggaatttaaagttgatattattagtttgggtggattgtgggttgtgaagttggtggaggaggtgtgagtttagttatagttgtaggtttttgtggttgtaattttgttgtgaggggttgttgtgtatttagaggttagaggtttagatgatagattttagatatgttttttgtatttgtttttggaggattttgaatgttgtgtttatttggtggaagttgttgtattttgaatttgtgttaattggggttggtgggattgatatgatggatgtgggttattgtgggttattaggttttgggagtgatagatgagtttggtgggtgagagtagtttaaggtatgtgtttgttgtgggggttgggaaggagaagtttttgttgggtgagaagatttgtgagaagattttttttagtttaattagggttagggatgggtgattggtaagggtttgttgagtttggttgatttgtgttggggtttagttttttgtttttttttgtggagttgtttggggagttaggagtagtggtgttgttttttgttttttttttagttttagggttggttttttatttgggattgatttggtgtttggaattgtttatgagttttttaggttttattgtatttttttgttgtttatagaggtgtattttgtggatattgtttatgatagggagtttgtttttttggagatgtttgtttttttggagatgtagtttgtttttgtaaattttttgtggattttaaggttttgggagggatttgtttaggttttttttattttgttgtttgggttggatggtttttgattgatgtagtttagttaattagagggaaggagaggaggggatgtttgtagtgattttgtttgtttgtttgtttgtttttgagatggagttttggtttgttgtttagggtggagtgtattggtgtgattttgaattattgtaatttttgttttttaggtttaagtagtttttttgttttagtttttttagtagttggggttataggtgtttgttattatgtttggtttgtagttgtttttttttgagtaaagtaggaggaagagtttttgggagtaattgtttagtttggggtggggtgagtgtgtggggtttgggggttaggggttgtggggagtgttgggtggaagttggtttgggagagttgtagtttgtattttttattttggagaaaaagtttttttttgaaattttgtatatatatttttagttttttggatttaatatgtttgtgtgtatatatttttgtagtttatttgggatttattgtattttttttttatatatttttgaaatgattagtatttataattgtaattaatgtttttttattattaatttagttaaaagatttttttggagggattattgatgttggtttattagtagtttaattttttaataattagtaattaaaagtaaataatgggttggatgtggtggtttatgtttgtaattttagtattttgggaggttgaggagggtggataatgaggttaggagattgagattatttttgttaatatggtgaaattttgtttttattaaaaatagaaaaaaattagttgggtgtggtggtgggtgtttgtagttttagttatttgggaggttgaggtaggagaatggtgtgtattttggaggtggagtttgtagtgagttgagattgtgttattgtattttagtttgggtgatagagtgagatttagttttaaaaataaataaataaaagtaaataatgtttgtagttttattgattggttttttgttgtttagttagtgtgtgtgtgtggtggtggagagttagaagagatgtttttaggtgggagtgatggagagaatttgggttttttagttttgaaggttgttttaggtattatttttaggagaaaaagttaatgttttagtttttttggttattatgttttttgtttagtatttggtgagagtttatgagtggaatggaatttggtagttgtttatgttgtttttggtttttggattattgtttttgggaattttgggagttttagagttgttttgattggttttgtgagtttaagtgagttatttttttagtatttgttttttgatttttgttgaaaaatttattagaggatatgttttttatttgtgttttttattatggtttaggttttggttggagtattaggttgggtttgggaatttatgtgtagaaaaagaagttaaagagaaatttgattttgggttagagtgaaaggaaagattaaaggtttttaaatttttggaagttaaagggtaggaataatttatgagagtagattttagtttattttattttagtagttttttttttttaggtggtatggtttttttttttttttttgaattttaggatatgggttttttagaattgttatagtttatttttaaattttttttttagtttttttttatagttgattaagatttgaatggtggtttttaaa

SEQ ID NO: 422 - DNA, 4500 bp, Artificial Sequence
  chemically treated genomic DNA (Homo sapiens)
ttatgtgaggatatagggtaatgatagttatttatagttaaggaagagaggtttttaatagaattaattttgtttatatttggattttaaatttttagtttttagaattgtgtgaggagaaatgtttgttgtttatgttatttggtttgtggtagattaatatggttatttattagttggttggttttgggtaggttttttatgttttttgtgttttagttttttttattgtagaatgggatagtaatgtgtttattttttgggttgtggtgagttggttaagatgtgaagagtttggagtaggttgagtaggggtattgtaaatttgtttttgtttttatatttttttatgatttagaggttggggatattgggtattttgtttgtagtttttatgttagtttatttttaaatattttaattagagtttttataaatatagttaaatggagtagaggtaggtagggtttgtttttgatagtttttgttaaggatgtttgattaaggttggtaaggaaggtggttagggtttagagtttattgttttttgggaggagaaattaaaatataaatgaaaaagggttttggggttgagtagggtatggaggtggttaggataggagtttagttgtaggtatagttttaatttatgtgatttttagggatttggaaagggatttggtttagtttatgtggtagttatttttttaattttttaattgtggttttaggatggttgttgggatttttagagatggatttttatggtttttaggggtgtaaaggaaggatagtgtggagtgtgttgtaagttttaattgatattgtttgagtatttgttgtatattaagtgtttttatatagtgaaggtgaggttgtaggttatgtttagtttatagatagagatattaaggttatttaggtattaaggtgatgtagttattgaggttatatgagaagtaagagggtatttttgtggtaggtgggtagtgggagttagtgtgagttggggagtggagatttaaagagttgtgttgggtggttagggaggttttgatttaatgtttagtattaggtgagttgatttgggggtgtttatgtgtttatttatgggagattaggaggtagaggtaggttgggatgagagttttgggggtagagttggtttgggtggtttttttttatagattttatagttggagatggagatggtttaggggtatgtttgtttgtggttttggttttttaagagttttgagattaatgtttttggtttagtttaagttgtataggaaagttattttgtggattaagtttgggtatatagagagggttggattttatatgtatttgtggtaggtttttggagatttttggaatatttttgtattttttttttatttttaagtaatatttttttgggaaaatgtttatttggttttagttgaatttaggaaattgattgttatttatttatatatttagagtttaattggggtggtagggatatatgtataggattgtgtttatgtttgggttgtatgtttgtagttgggggatatatatatagagtgatgtgtatttattatttatatatatatattggttatatatatgtttatattaaattatttgtttataattatttatatatatattatttttatatttatattttatagttgttgaggagggtgaggataggttgttatttttattttttttataggatgagttgtaaaatggtttagaggttttagtgagggtgtatgtgtgtttgttgagtgttttagtgttttgggatagttttttttagtattgttgatatagtttttattgttttttgaagtgtagataaaatggagggtagttttgtttagggtttttttggttttaggaagggttaataggtagtaagggttgttttttttaggaatgttttgtttgagtagtaagtgattgtttagttttggttttgggggatttttttgagatttgtgagtagatgaagttggggattagtagatatagttttaggttgggaggaaaaatttatgtgtgatttatgatgtttttttagatgtggggtgatgtaggtggtttggagttagggttgatgtttaggattttaatatttttttgtatttaaggggtggatttgggggttatgtaggtattaaggtaaggtatgagtgtgtgagtgtgtagtagatagtatggtagtgtggttttattttaagttgtagggtagagtatgagagatttaatgtggtttttggatggggttttaattattttgtatggttaaggtttaagttttaagagttgggtagttttttgtatgtggggtggttataagtttgtagttgttttttttgttgtatatttattttgagtttattttggagtaggtttgggtttttggggtatttttatattttatttgtttatttttaaataatttttaggttagaaaattttttgagaagggatagtaggatttgggatttttttatttatttatttatttatttatttattttttttttaataaatattttggtgagtgtagtggtttatgtttgtaattttagtatttagggaggttaaggtgagtggattatttgaggttaggagtttgagattagtttggttaatatggtgaaattttgtttttattagaaatataaagattagttaggtatggtgatgtatatttgtaattttaattatttaggaggttgaggtaggagaattatttgaatttaggaggtagaggttgtaatgagttgagattatattattgtattttagttttggtaataagagtgagattttattttaaaaaaaaaaaaaaaaataaaaaagttttgtgggttgggtatagtgttaattgttagtaatatttaggtaaggaagatgtttatttggtttttgtttattaggaatttggaggttagaaatatagtttttttgtagataatttgtagtaggatagaaaataaagtttggttatggtggggttatttagtttgaggtatttaggggaggttttttggaggaggtggtttagttaaagttttgaaggatgtataagagtgagtgagttaaggaaggggttggtatgagttaagttgtagagtttaggggataggttaggttggagaagggatgttgagaggttttatgaagtttgttttttgttgttaatgaattttttatggaggtttggaagtattgtatggttttagtatatattttgattttattatttttgtttttgtatattagttggggatgttgttttaggaagtgattttattttttaaatataatgtgtttttttgtaatttaatttttttgggggtgtgtggaggtttggaagttggtttgtttgtttttgtagttggtggttgaagtgtttttgtttttttggttatggtttttttgttttttttttgtgtgtgtgtttttttgagatagggttttattttgttatttaggttggagtgtagtggtgtgattttgttttattgtaatttttgttttttgggtttaagtgatttttttgttttagttttttgagtagatgggattataggtgtatattattatatttggttaatttttgtatttttttagagatggggttttattatgttggttaggttggttttaaatttttgattttttgatttgtttgttttagttttttaaaatgttgggattataggtatgagttattgtgtttggttatatttatattttgtggggattagggttttttgttataattaatttataatagttgaaggaggttatgaggttttagtgggatttttgggggatagggatgggaggaaatttaggattagatagattataaaattgtttatagatttttgtttttagttgtttttgttgagaattgggagttagaaaaaggaggttaaattttagggtaatgtttatgttttttgtaatttttggttttattaaattagtagtataattttagttttattttgtagagttagatataatggggtattagaagggaattgaatttttttttaattataatggtttatagatattgtttaatttgtaatttgggagttaatgtggttttttttttttgtagttatggggttgtttgtatatatatgtttttatttatttggatggagtatggggtttattttgtaaggtgagatgttggataaggttgtttttagtttggtgagtggagtgttgtgtttagttttgttttttttttgtttttagttaggtttattatatagaggatgttagtgtggttgttatatgttatatggagtatatatgtatggagttattttaataggtaggtaggagtataattttttttttaattatatatttagtatttttgagaaaatgagattttagtaatttaattggattgagaagtggggttataataaaatggaatttgtaataattgtgtagttaaattag

SEQ ID NO: 423 - DNA, 4500 bp, Artificial Sequence
  chemically treated genomic DNA (Homo sapiens)
ttaatttaattgtgtgattgttataaattttattttattatagttttgttttttagtttaattgaattattaaaattttatttttttagaagtgttgaatatgtaattagaggaaaaattatgtttttgtttgtttattaggatggttttatgtatgtgtgttttatgtgatatgtgatagttatattgatgttttttgtgtggtgggtttggttggaggtaggagagaggtagggttgggtgtggtattttatttattgggttgggggtggttttgtttgatgttttattttgtagggtgggttttatgttttgtttgggtgaatgagaatatgtgtgtgtaggtggttttatgattgtaagaggagaaaattatattaatttttagattataaattaaataatgtttgtgggttattgtaattaaagggaaatttaatttttttttaatgttttattatgtttggttttgtaaggtaaagttgggattgtgttgttagtttaatgggattagaggttataaggagtatgaatattattttgagatttggttttttttttttggtttttaatttttagtaggggtagttgggggtagaagtttgtgagtggttttgtaatttgtttagttttgaatttttttttatttttgttttttaaaagttttgttggggttttatagttttttttgattgttgtgggttgattgtggtaggaggttttggtttttatagagtgtgggtgtggttaggtatggtggtttatatttgtaattttagtattttgggaggttgaggtaggtggattaagaggttaggagtttgagattagtttggttaatatggtgaaattttgtttttaggaaaatataaaaattagttgggtgtgatggtatgtgtttgtagttttatttatttaggaggttgaggtaggagaattgtttgaatttgggaggtggaggttgtagtgaaataagattgtgttattgtattttagtttgggtgatagagtgagattttgttttaaaaaaatatatatataaaaaaaaaatggaagagttataattggaagagtaagggtattttaattattagttgtaagagtaggtaggttagtttttgggtttttatatatttttgagggggttaagttgtaggaagatgtattgtatttaaaaggtgaggttattttttggagtagtatttttagttggtatgtggagatggaagtgatgggattggggtgtgtgttggagttatgtggtgtttttaggtttttatgaagggtttattggtagtagaggatgggttttatggggttttttagtattttttttttaatttgatttgttttttgggttttgtgatttgatttgtgttggttttttttttggtttatttatttttgtgtattttttaaggttttagttgggttattttttttagggagttttttttgagtgttttaggttggatgattttattataattaggttttgttttttgttttgttatagattatttgtagaggggttatgtttttaatttttaaatttttggtgggtaaaaattagatagatattttttttgtttgggtgttgttagtagttagtattgtgtttagtttatgagatttttttgtttttttttttttttttgagatggagttttgtttttgttgttgagattggagtataatggtgtgattttagtttattgtaatttttgttttttgggtttaagtgatttttttgttttagttttttaagtagttgggattataggtgtgtgttattatgtttggttaatttttgtatttttagtagagataaggttttattatgttgattaggttggttttgaatttttgattttaaatgatttatttattttggtttttttaagtgttggaattataggtatgagttattatgtttgttaagatgtttattaagaaaaaaatgaatgaatgaatgaatgaatgaatgggggaattttaagttttgttgtttttttttagagagttttttggtttaagagttgtttgagagtgggtaggtgggatatgggggtgttttgggaatttaggtttgttttagggtgagtttgggatggatatatagtaggagggatagttgtaggtttgtgattgttttatatatgggggattgtttagtttttagaatttaggttttggttgtataggataattgagattttatttagagattatgttgggttttttgtgttttgttttgtagtttgaggtgggattatattgttatgttgtttgttgtatgtttatatgtttgtgttttgttttagtgtttgtatggtttttaggtttattttttgggtgtagagaaatgttggggttttaggtgttagttttggttttaggttatttgtattgttttatgtttgggagggtattatgaattatatatggatttttttttttggtttggagttatgtttgttaatttttagttttatttatttatagattttaggagaattttttggggttggagttaggtagttatttattatttgagtggagtgtttttggggaaggtagtttttgttgtttgttggttttttttggggttagggaggttttgagtagagttgttttttgttttgtttgtattttagagggtagtgggggttgtattaatggtgttggggagaattgttttgggatgttggaatatttggtggatatgtatgtatttttgttgaagtttttgagttgttttgtagtttattttatgagggaggtgggagtagtgatttgtttttattttttttagtagttgtagggtgtgagtgtggaggtagtgtgtgtgtgagtggttgtgagtaaatgatttagtgtggatatgtgtgtgattaatgtgtgtgtgtaagtgatgggtgtatgttattttgtgtgtgtgttttttagttgtgggtatgtagtttaggtgtgggtatggttttgtgtatgtgtttttattattttagttgaattttgagtgtgtgagtgggtggtaattaattttttggatttagttgagattaggtgagtatttttttaaaggaatattgtttgagaatgaagggagaatgtaggggtgttttaggagtttttaggagtttgttatagatgtgtgtggagtttagttttttttgtgtgtttagatttggtttataggatggtttttttgtgtggtttgggttaagttgggggtattggttttagagtttttggagagttagggttgtaggtaggtatgtttttgagttatttttatttttggttatagaatttgtgaggaggaattgtttgggttagttttatttttaggatttttattttaatttgtttttgttttttggttttttataagtggatatatgggtatttttaggttagtttatttggtgttgggtattgagttagagtttttttggttatttagtatagttttttgggtttttgttttttaatttatattaatttttattatttatttgttatagagatgtttttttgttttttgtgtggttttggtagttgtattattttggtgtttgggtggttttggtgtttttgtttgtgagttggatatggtttgtagttttgtttttattgtatgaaagtgtttagtatatagtaggtgtttaagtagtgttggttggggtttatagtatattttatattgttttttttttgtatttttggaagttgtgagagtttatttttgggagttttagtagttattttggggttgtagttaggaagttagagaagtgattgttatgtgggttgagttaggtttttttttaggtttttaaaaattatataaattggggttgtatttgtagttgggtttttgttttggttatttttatgttttgtttagttttggagtttttttttatttatgttttaatttttttttttagaaaatagtgagttttgagttttagttattttttttgttagttttggttgggtgtttttagtaagggttgttgggagtagattttgtttgtttttgttttgtttggttgtgtttgtaggggttttggttggggtgtttaggagtaagttggtgtgagagttgtaagtaaggtgtttagtgtttttggtttttgagttgtggggaagtgtaagaataggagtaggtttgtagtgtttttgtttagtttgttttaggttttttatattttaattggtttattatagtttaagaggtgggtatattgttattttattttatagtagaggaaattgaggtatagagggtataggaagtttgtttagggttagttgattagtaagtagttgtattggtttgttatagattaggtggtataaataataggtgtttttttttgtgtagttttgaaggttgggagtttgaggtttaggtgtgggtagggttggttttgttggaggttttttttttttggttgtggatggttgttgttgttttgtgtttttatatgg

SEQ ID NO: 424 - DNA, 6499 bp, Artificial Sequence
  chemically treated genomic DNA (Homo sapiens)
tattgtatatttttatttataattggtagttaattattgaatatatatagatataaatgtattttaatatattattatttttatttagattttgtgtaatatttaattatttaattatattaataaataaaagtttttagaaattgatgtatttagtataattaaggggtaatttgtttatgattataggagttattttatttatattaatttgatgtgaggagataattaaatttttttttttttataagaaaaatttaattttgggaggtttaggtaggagaattttttgaatttaggaggtagaagttgtagtgagttgagattgtattattgtattttagtttgggtaataagagtgaaattttgttttaaaaaaataaataaataaaataaaataaaaagtaaaatttaatttttatattttttttttaaaaatattatattattgaaatagaatagaattttggattttaatgtttttatgttttttgataatgtaaagattatattaagaataatattgattttttgtgtatatgtgtgaaattatgttgagttgatgtatttagaaaagaaattgtagtgatattgggtatagaatttttaattttaattttttttttgttgtggaatagaaatttagttttattttttttgtttataatatataagagtagataattagatatgaggtgattaaatatataaattgattttatagttattatggaaagattataatatgtttggatgaggtgggggaaagagtttttttttgaattgagatttgaataggttttagatagattaaaaatttatggtttgttttttttaattttttattattgattatttgggagaattaaaatggtttggattataaagtgattataattagtagggtaggtatattaaataaaaatggggtgagtgtgtttggatgggaaaaattggggtgtagagaaatattttttgttttggaggttttgtttatagtgagtttgaggatgtagatgatatggaatatgagttttattaggatatatatttttttgtatagttttttttgattagtgttgtttattgttttaggtattatttttagttattttgtgttaggtatttaggatagttttgtttaaagtatgattgttttttggttagtgaagaaatagtaaagaaatgagagtttgtttttgaagtttttgtagtaatttaatatttttgtaatgttgtggtatatgttttatattttttaaaagtatttatttgtagattagaaataaaagagttttttagtatagatagtttgagagatgttattgtagagtgttttgggaggatgggatttttttagatattgatggttttttggagtggtgttggagtttgttgagatagggatgtggggattgttgtggaatagtatgttgtgaaaataggtatagatgggttgttgttatgtatttagtatttggtaggtttaggtattttgttttggggagatagagtaatagttgttatttttaaaaatgtgatataaatatgatttttgttttttattgtatgtgtatgtatgtgtgtatgtgtatgtgtggttggtgtgtgggtaaataatattggtgagggagttagtagtgtagagatgtagagatgaatttaatgaatttatatttggaggtttttgaaaggagttttgtgtatgtataattaggaagtagaagtgtagttgtaggttagttttattttttggtggaaatagtaaattatagttttagtattttttatttgtagtaaaagaaatgtatgttgtatttgggaggggtaggagaattttttagaatttggtgggtttattagttagggttgtgtagagaaatagaattaatgagataaatatgttagatagatgatagatagatagatagatagatagatagatagatagatagatagagatgatagatgatatagatagatgatagatgatagataatagatgatatatagatagatatagtaaatagatttatagatatgatagagagagaatgagagagatttatattaaagaattggtttatatgattgtgggggttgtaaattttatatttgtagaatttgttggtaggatggaaatttaggtaagagtggatattgtagttttgagttgaaagtttatagggtagtaagttggaaatttaggtaaggtttttaggttgtagttttaagaagaattttatattttttaggaaattttagtttgtgtttttagggtttttaattgattgaatgaagtataaatattatggaaggaaatttggtttatttaaagtttgttggattaagtattaattttaattaaaaaatgtttttatagtaatatttagattattgtttagttaagtatttgggtattatagtttagataagttgatgtataaaatttattattataagggaggaatttatatatatattttattgtagtaaaatttttatagtttaatgttttgtattttttttagaaggaaatgttttagtgtagagttgaatattgtatttttttgtagtttatataaattttatataattttgatttgttgagttttttttgaaaattggataatttaagtgtttatgaaaggttttaattgtttaagaaaatagattgtttgtgtgaattataaagaaaaagggattttagaaggaatattggtattttgggaagtaggttggggtaaggtttgtataagtgaattagaagttttaggtatgaagttagtatttttgttatggtttatgttagttgagtttttatttttgttttgtgtttggtttttagattttgtgagtttgttttgggatagggttatggttaatttagtagagattttggtaaagtattttgggaatgagagtgagaaaggtttaaagtagttaaggtttaaagataatttttgattttatttttttaaatgttagtttttaagattttaggttttttggattttaatttttatgttattttaaaggttttaaattttagttttagtagttttagtttatagttttaggtttttagagattattttagtaatttttaaatattattttagggatttagttttgatagttaagattattttttttataaaataattgtagatattaggtgaagatttttaaagttttaaggaaattttaaattttattttgaggatattgattttattaaagttttgaggaaattttaaattttattttgaggatattagttttattgttaggaattgggattttaatttatagtatttggattttgagaatagaggttttggggttaaatgggttgaatttagtattttatttttatgtttttgggtggatagtaatttttttttattgtgtttttttgtgggttttaggttttatatttgagggatgtggttttttttttttatattatgttggttaagaatgatttatatagttattatggaatattgtatggagataaggagtggttgtgtttttgtttgaagggtttattttatttatgaggtaggatgatttttaaggtagtgttatttattagagttaaagtttaggtaaggtgtttaggggttagttgtaatatgaagtatattagttaaggtagttttaaagagtattgttagaggaagaatttatatttggttgtttaatgaggttgaaaggtaaatttaggttaagtaggttaagtaaagaggttagtttagtattttgggaggtagaggtaggtggattatttgaggttaggagtttgagattagtttggttaatatggtgaaattttgtttttattaaaaatataaaaattagttgggtgtggtggtatgtgtttgtaattttagttatttaggaggttgaggtaggagaattgtttgaattagggaggtggaggttgtggtgagttaagattaggttattgtattttagtttgggtgatagagtgaaattttgttttaaaaaataaataaataaataaataaaaataaaaaagaagttagaaagtttatgaaaaatatttggagggaagaagttagtttaagaataaaagtattaggttagggtgtttaagatttttaaggattggttttggttgtgtagatatttaaagagattgtgtaaggttggataggagggtgagttggttaaaaaggtgatttgttaattgtggaattaattattgtttaatgttttggataattgagtttgatttgtaatggttaggtttattattgtaaattagttttgaagtataaataagtttattaaattattttttttgtttatatttttttttattttttgatttatgtaatttttgtagtttatatttaaataaaaaataataatatggatttgttattatgtatgttgtggtttatttttaattgtaaagtttttgattatttttttgttatgttgatttttatgttagaagaaaatgttttgttatttattatgagtgtagaaaattgtttattagaaatgattttaaatagtaaaggatgtatatttgaaataatagggttgtaatgaaaaagtatatattttttaattttatttaatatattgtatttgtagagtaaaagatatagaaaagtattttatgttttaaaaatgtaagtttgagagtgaaaaatagagataataaaaatttttttttaaatattattggtggaaaagttttaaagtaatagaaagtatatataaaatgtttgtgaatttttgtgtaataaaattatatatatatatgtgtgtgtgtatgtatatttgttttttttgttttgttttgtttttttttttttttttgagatggagttttgttttgttgtttaggttggagtgtagtggtgggattttggtttattgtaagttttgttttttgggtttatgttatttttttgttttagttttttaagtagttgggattataggtgtttgttattatgtttggttaattttttgtatttttagtagagatggggttttattgttttagtggggttggttttgattttttgattttgtgatttgtttgttttggttttttaaagtgttgggattataggtgtgagttattgtgtttggttaatgtatgtatatttgtaatttagatttgtaaatgtagttatatttatatttatatattaaatgtattaaaaagatttattaagttttttatagttagtttataaatttttagtttttttatatatttgtattttttgttttaatatgatataatagttaaaaaaatttaaaaattaataattaattaagttttttttttttgtagattatattagttattatttagaaatattaatttattgttttaaaaataatttttttagagatgtttggtatttagtatatgaaattatttataattgaataatataaataaaatagaaaaaagaatttatttttgggatatttgaagaaagtgatttataaatttagtttatttttgagttttattatttttaggaaaatggtttttatgttatttttatgttatgtttgatttgttttgtttgagtttgttttttagaaagattgtgatttttggtttgttgaatatgaaatttatatgattatttttgggaaaaattttttttttagtgattgtaagttaggttttgtggttgagaagtattagttgtatttggttgattgattgtattattttgtttttatgttgtttataaagatatatttgagatttggtaatttataaaagaggtttaatagatttatagtgttaagtgggtgggggtgttttataattatggtggaaggtgaaaggtatgttttatatggtggtagataagagaagagagtttgtgtaggaaaatttttttttataaaattattagattttatgagatttatttattattataagaatagtatgggaaggatttatttttatgatttaattatttttaattaggattttttataatatgtgggaattatgggaattataatttaagataagatttgggtgaggttatagttaattatattattgatttttattatattataaagaattattttgtagagagaatttgttttttatttttaataatttgtttattttggatattttatataaatagagttatataatatttgttgttggtttttttatttagtgtaatgtttttaaggtttatttgtgttagagtatgtatttttgttttatttttttatattattaaataatatttgattgtatggatgtgttatattttatttgattttttattagttgatagattgttgggtttttttattttttggttattatgaatgatggtattatatgaatatttatatataagtttttatgggtatatgtttttattttttttgggtatatatttaggtgggggattgttgttatatggtaattttatgtttaatattttgagga

SEQ ID NO: 425 - DNA, 6499 bp, Artificial Sequence
  chemically treated genomic DNA (Homo sapiens)
tttttaggatgttaaatataaagttattatatgatagtaattttttatttaggtatatatttaagaaagataaaaatatatatttatgaaaatttgtgtgtgaatgtttatatagtattattatttgtaatagttaaaaagtagaaaaatttaatagtttgttaattgataagagattaaataaaatgtggtatatttatataattgaatattatttagtgatgtaaaggaatgaagtaaaggtatatattttaatatagatgaattttgaaaatattatattaaatgaaaaagttagtaataaatattatataattttatttatgtgaaatatttagaataaataaattattagagatggaaagtagattttttttgtaagatagttttttataatatgatgaaagttagtgatatggttggttgtgattttatttaaattttattttgaattgtagtttttataatttttatatgttgtggagggttttggttggaggtaattgaattatgggggtgggttttttttgtgttatttttgtgatagtgagtaagttttatgaggtttgatggttttataagaggaaatttttttgtgtaagttttttttttttgtttgttattatgtgagatatgttttttattttttgttatgattgtgaggtatttttatttatttgatattgtgagtttgttaaattttttttgtaaattgttaagttttaggtatgtttttatgagtagtatgaaaatagagtaatatagttagttaattaagtatagttgatgttttttggttataggatttggtttgtagttattaaaaaaggaattttttttaagagtgattatgtaaattttatatttaataggttaaggattataatttttttggaaaatagatttaagtaagataagttaaatataatatagagatgatatagagattatttttttaaaaataatgagatttagggataaattgagtttgtaggttattttttttagatgttttaaaagtaagtttttttttttgttttgtttgtattatttaattataaatgattttatatattaagtgttaaatatttttagagaaattatttttaaaataatgaattaatgtttttgaataatggttgatatagtttataagaaaaaaaaatttggttaattattaatttttaaatttttttaattattatattatgttaagataaaaaatgtgaatatgtgaagaagttgggaatttatggattgattatgaggaatttagtgaatttttttggtgtatttgatgtgtggatatgaatgtggttgtatttataaatttgagttataaatatatatatattggttgggtgtggtggtttatgtttgtaattttagtattttgggaggttgaggtgggtagattatgaggttaggagattgagattaattttgttaaaatggtgaaattttgtttttattaaaaatataaaaaattagttgggtgtagtggtgggtgtttgtagttttagttatttgggaggttgaggtaggagaatggtgtgaatttgggaggtggagtttgtagtgagttgagattttgttattgtattttagtttgggtgatagagtgagattttgttttaaaaaaaaaaaaaaaaataaaataaaataaaaaaaataaatatatatatatatatatatatatatatatgattttattgtataaaaatttataggtattttatatatattttttattgttttgagatttttttattaataatatttagagaaaggtttttattgtttttgttttttatttttagatttatatttttaaaatataagatgtttttttatattttttattttatgggtataatgtattgaatgagattgagaaatatgtatttttttattataattttattattttaaatatatattttttgttgtttagaattgtttttagtaagtagttttttgtatttatggtgaatagtaaagtgtttttttttgatatgaagattagtatgataggagaataattagaaattttatagttagaagtaaattatgatatgtataataataagtttatgttattattttttatttagatatgagttatagagattatatgaattagggaataaaagaaaatgtaaataggaggggtagtttaatgaatttgtttatattttaagattgatttataatggtaagtttaattattgtgagttagatttagttatttaggatattgggtggtggttgattttatagttagtagattatttttttggttagtttatttttttgtttagttttgtataatttttttaagtgtttatatagttaggattaatttttggggattttagatgttttgatttaatgtttttatttttggattaattttttttttttaaatgttttttatgggttttttgattttttttttatttttatttatttatttatttattttttgaggtggagttttattttgttatttaggttggagtgtagtggtttgattttggtttattataatttttgtttttttggtttaagtaatttttttgttttagttttttgaatagttgggattataggtgtgtgttattatatttagttaatttttgtatttttagtaaagataaggttttattatgttggttaggttggttttgaatttttgattttaggtgatttatttgtttttgttttttaaagtgttgggttgatttttttatttggtttgtttgatttagatttgttttttaattttattaaatagttaggtgtagattttttttttggtaatattttttgagattgttttggttaatgtgttttatgttgtaattggtttttaaatattttatttgagttttgattttagtgagtagtattgttttgagggttattttgttttatgaatgggatgagttttttaggtaggggtatagttattttttatttttatgtaatattttatgatgattgtgtagattatttttggttaatatgatataaaaggaggaggttatattttttaaatataggatttaaaatttatgaggggatgtggtggaggagggttgttgtttatttgggggtgtgggagtgaggtattggatttagtttatttggttttgaagtttttgtttttggaatttgggtgttgtgggttgaggttttggtttttaatggtgggattggtgtttttgagatgaaatttggggtttttttggggttttggtgggattggtgtttttaggatgagatttagggtttttttggggttttggggatttttatttaatatttgtgattattttatgagaggagtggttttggttgttagaattggatttttggggtgatatttgggagttattggagtgatttttgaagatttagggttatgagttggagttgttggggttgaaatttggggtttttgaagtggtatggagattgaggtttagagagtttgagattttgagggttgatatttggagagatggggttgagggttgtttttgggttttgattgttttgggttttttttatttttatttttgggatgttttgttagaatttttgttggattggttgtaattttgttttggagtgggtttatagggtttgaaggttaggtatgaggtaaaggtaaagatttaattgatataggttatgatagaggtgttgattttgtgtttaaaatttttgatttatttatgtaagttttgttttaatttgttttttggagtattaatgttttttttaaaatttttttttttttgtaatttatataaatagtttatttttttaagtaattaaaattttttatgaatatttaagttgtttagtttttaggagaggtttagtaaattaaagttgtatgggatttgtatgagttatggaaagatgtgatatttaattttgtattgaaatgtttttttttgggaaaagtataaaatgttaaattgtaaagattttgttgtaataaagtgtatatataaattttttttttgtgatggtgaattttatatgttaatttatttgagttatggtgtttagatatttggttgaatagtagtttaaatgttgttgtgaaggtgttttttagttgggattaatgtttaatttagtagattttgagtaaattggatttttttttataatgtttgtgttttatttaattagttgaagattttaagaatatagattgaggttttttaaagaatatgaaattttttttaagattgtaatttagaaattttgtttgagtttttagtttgttgttttgtggatttttgatttaaggttataatatttatttttatttgaatttttattttgttagtaaattttatagatgtaggatttgtagtttttataattatgtgagttaattttttaatgtaaattttttttattttttttttgttatatttatagatttatttgttatatttatttatgtattatttattatttattatttattatttatttatattatttattatttttatttatttatttatttatttatttatttatttatttatttattatttatttaatatatttattttattggttttgtttttttatataattttgattaataaatttattaaattttaagaagtttttttattttttttaggtgtagtatatattttttttgttataggtgagaagtgttaaggttgtaatttgttgtttttattagaggatgggattggtttatgattgtatttttgttttttgattatgtatgtatagggttttttttaagggtttttaaatataaatttattagatttatttttgtgtttttgtattgttaatttttttattaatattatttatttatatattaattatatatgtgtatgtatatatgtatatatatataataaaaaatgaaagttatatttgtgttatatttttggaaatgatagttgttgttttgtttttttggggtagggtgtttgggtttgttaaatattgagtatgtggtaatagtttatttgtgtttgtttttataatatgttgttttatagtaatttttgtgtttttattttagtaagttttagtattattttagggagttgttaatgtttagaagaattttatttttttagggtattttatagtagtattttttaaattatttgtgttgaaggatttttttatttttagtttgtagatgaatatttttaaaaaatataaaatatgtattatgatattgtagaaatgttaagttgttataaaagttttaaaagtagatttttatttttttattatttttttattgattagaaagtaattatgttttgaatagaattgttttaagtgtttaatatagagtggttgaggatggtgtttagggtaatagatagtattgattagggaagattgtgtaggaggatgtatattttggtggggtttatgttttatattatttgtatttttaggtttgttatgaatgaagtttttaaaataggaaatatttttttgtattttagttttttttatttaagtatatttattttatttttatttagtatgtttgttttattaattgtaattattttataatttaggttattttgatttttttagatgattaatgatgggaagttgaagaagataggttatgggtttttagtttatttaaagtttatttaaattttagtttagagggagatttttttttttattttgtttaaatatattatggtttttttatggtaattgtgaaattagtttatatatttaattattttatatttgattatttatttttatgtattatgaatagagaaggtggaattaaatttttattttataataagaaggaggttgagattggaaattttatatttaatattgttgtaattttttttttggatatattagtttgatatagttttatatatgtgtataaggagttaatgttatttttgatataatttttatattgttaaaaagtatagaaatattgaggtttaaaattttattttattttaatagtgtaatgtttttaaagaaaaaatgtgagggttaagttttattttttattttattttatttatttatttttttgagatagagttttatttttgttgtttaggttggagtgtaatggtgtaattttggtttattgtaatttttgttttttgggtttaagagatttttttgtttaagttttttggaattaagttttttttataggaaaaaaggaatttgattgtttttttatattaaattagtgtaaatgaaatgatttttgtaattataaataaattattttttaattgtgttagatatattaatttttaaaggtttttatttgttgatgtaattaaatggttaaatattatatagaatttaagtgggaataataatgtgttaaaatatatttatgtttatgtgtatttaatgattagttgttagttataagtgagaatatgtagta

SEQ ID NO: 426 - DNA, 4441 bp, Artificial Sequence
  chemically treated genomic DNA (Homo sapiens)
ttagtataaggtttttgttaagtttatggtttgaaaattttgtttttttttggatttgaaagtattttggtttttggatagtatagaaaaattaaatagttagaaattgaataattatagtataatttaggaggtttgttagtttgattgagttttattaattttttaattgtaagaaggaataaaatatatttgttggtttttatgttgtggtttgttttagagtagttatttaagtttatattttatgttagaatgagaagtgaattatttggggataaatgaggtgtgtatttgtttaatagtttagtgattttttggaatttaaatattaagtgaaaggatagggttatagggtagttgatttttggtttgttttttttttgtttgtttatggttttgattatgttatatttttttttgtggttagggttttatagagaattttagggttatggtttgttgtttagttaagaggtataaatttgttgtttaaatatgtgaagtttatagtttgggggttgggagttaaaggggaggtagttttatatgttttattttttttataaaatttaaagtagattaaataaaattggtgtgaaattttatgatttgatgttgttgtggttatattttttaagttgtaatttatttatttgtatgtgtgtttatttttaggatttatagtttgtttagtttttggggggaaagagaatatttgaaattttttgtaaagggtttgaagtatgtagtggtttgtgattaaagtttaggatagagtgtgtgtgtgtgtgtgtgtatgtgtgtgtgtgtgtatttatgtgaatgtgtgagtgtttatttttgtggggttttttttttttatttgttgtttttatgtaaaagtattatatatggtagtatttaggagtttttttatagttgaagtgttttaaatattaatgaatggaagtttggttatataatgtagataagttttaaggtatgttttattgaatggtgtattgtagtgatttgggaaaggaagagaggtataaattgtgttggttagttatttagataaaatgaagttatgtggaaaattaaatttattaaagtatgaagattgttataagttgttttaagttggttatttttaaaggggtttggtttgttgtaggagtaaatgtttatttttttttttagattttttttatatgttgttttatgagataatgtgtagtatttgataaaaattatttttttattaatgatgtttttattggaaatgtttattgtttttgttttattatttatgttttgaaaggtattgtatatttgttaaataagtaaaaggaaagagaattttgtggtttaagttggtttgtagaaattttaataaattttagagttataaggaattagaaaaaggaaaagggaaggaggagttagatttatatgaagagggggttttgtaaaaatatatatattagattttttttgtttggttagtttattattaaatgtttggttgatgtggattagtattgagattgagtagttaatgttgaatttgggttattgttttaaaatgtgttttaataaatataagggggaggaaatggatttgggaaggtttgttgttagttttgtttttgtttttatattgtttttgtatagtggtgtaggggttatatataggtgttggtattagtattaatttgatttaaattttggttttatatattttgtaattttgggtatattatttgtttgtgttttggtttttttagatgtaaaataggaatattaatagaaggtgtttaagtatttggtaagtattttaaaaatattagttattattattagtatttggagggtgggtttatttatattttaagaaaggatttttttaattttattttttttgtgtgttggtttttaaaattgatgaatggtatgttgttgggaaaaatttatttatttttattttttttttaattggtgagtaagtgtgtattgttttgatattttttggatagtaaataattgaatttgttgattagttgttatgatgttaagttttaagttaatagtggttaatgattgttttgggaaaaaataatattttgattttttaattatggtttaagaagttttgggaatgagggtttgttagttattgttatttttttttgaggtaagtataatgtgttgtggaaataggttatttttgtattgttggtaagagtagtttatatagtataatgattgagtgttatggttgtgttttttgtgtgttttaggaggaaattgaagagatatttttataagagtttgttgaagaggattagggggtgttaatgtttgatttttattttagtagtagttggattttttgaagggagaagatattgtagtgattatttattttgtattgttatggtttttttatttttatttggggtggggtggggtggggtgggggaggggggggtggggtggggagaaattatataattttaaaaaggattatattaattattttttttgtaatttttttatagttttaggtttagtgaaaaattgttgtaaatataggggatatagtttaataatgtaatttttaattattgttttttttttttttaatttattaatagtttgttgatttgataagtaagagtgggtgggtgagaaaaattgaattgggtttagttaattattgtattgtatgtaaataagaaatgtgttatatttgtgatgttgggtatttatataggaagaatgtggtgtgtaatattgtgtatattttaaatattattttaatttattttttgtagtgaattttttgtttagaatattaaagataaggattagatattatttttttttttttgtataattttgtagatatttatttgatgatttttaattttttatttttaaatgagatgaaatgttgatgtatttttttatttagttaataaattagaaaaggttatgtttattttttaaaaagggaagtaagtaaataaatattgttaatttttttatttatggatattatatatattagtaggagtaataaatttatttatagtatttgtttttaggataatattttatttttaggaaatttattttttatagagttaaaatgttatttagtaataaataatatttgttagttttagagtatttaaggaaattagataagtaaaattattttttttgtaatttaatgaaaaggtataatagaataatgtatgatgaatttatttaattatgaggtgggaggagtgaaatttaaattttttttgttatagttatatattaatttaaaaagtaaaaaaaaaaaaggggggggtaatttttttttgtgtttttttttttttttttttttttttttttttttttttattgtgtattagtttttatgaaagatttgaatattatttattttaaattaagtatatgtgttattttaagtaatatgttttgatataagatggttgattaaggtgtttttttttggtttgagtttattatttttttatttaaattgtatttttagttagagatgtaatatatttttattatttaatattatttttgaatgttataatgaatttatagtttagtatttattatatgttgttatatataagtaatgtaagaaaaaaatttattgggtaggtgattttaattatttgtagttttttttgtatatttaattatagttaaagaagtaatttttttattgtgttttagtatgattatgtatttttttatgtttttttaattaaaaatttttaaaatatttgttttagtttttttgttagatttttatattaatttgaaaattttttaattaagttgtttttaggtttttaaggataattttttttaattatattatatattatataagatttgattgtaatatttaaatattattttttaagtttgtattttaaatgaattttttaaggagatggattaattgatttgtaaagatttatttttagattttaaaaggaatgaatttgttatttgtagtatttatttgtttttttaatgtttgaaatagtttaaattgtagttaattttagttaaaattatttttgtaaaagatatttgatagaaaggaatatgtttttatatatttttgtaaaataagtaaataataaataaaataaaagttaatttttaaagaaatttgaagttttgtaggtgagatgtaataagttttgtttttgtataatgtaattaaaaatatgtgtttttaagattagttgaatataagaaaatgtttgataaatatttttatgtattttatataaatgtgatttttgtaatatgttttaattagatttattttaaatgttttttatgtagagtttttatgttttttttttttagtgagtgtgttgattttttaatatggtattattaattg

SEQ ID NO: 427 - DNA, 4441 bp, Artificial Sequence
  chemically treated genomic DNA (Homo sapiens)
tagttgataatattatgttaaaaagttagtatatttattaggagagaaaggtataaaaattttatataagaagtgtttaaaataaatttggttgagatatattataaaaattatatttgtgtaaaatatatgaaaatatttgttaagtatttttttatatttaattaattttaaaaatatatatttttgattgtattatgtaaaagtagggtttgttgtattttatttataaagttttaagtttttttgaaggttggtttttattttatttattatttatttattttgtaaaagtatgtaaaaatgtgtttttttttattaaatgttttttataaaaatagttttgattagggttagttgtagtttgaattattttaaatattgaaaaaataaatgaatgttgtaagtaataagtttattttttttgaagtttggaggtaggtttttgtaagttaattagtttatttttttaaagaatttatttgaggtatagatttggagggtaatatttaaatattatagttaaattttgtgtgatgtgtagtgtgattgaggaaaattatttttaagaatttaggagtgatttggttaaaaaatttttaagttaatgtagaaatttagtagagaagttgaaataagtattttaaaaatttttaattaaaaaaatatagaaaaatatatagttatgttgaaatatagtaaggagattgtttttttaattgtaattaagtgtataaaaagaattgtagatgattagaattatttatttagtaagttttttttttgtattgtttgtgtatagtagtatgtaataagtattagattgtaaatttgttgtaatatttagaggtagtattgagtagtggggatatattgtatttttggttaaaagtgtagtttgaatgaagagatggtgaatttaagttgaagaaaagtattttggttaattattttatgttaaaatgtattatttgaagtaatatatatgtttaatttgaggtaagtggtatttaggttttttatggaaattgatatataatgaaaagagagagggagaggaagagagagagagaaagatatagagagagattgttttttttttttttttttttgttttttaaattgatgtataattatagtaaaagaaatttagattttgttttttttattttataattaggtgagtttattatgtattattttgttgtatttttttattaaattataaagaggataattttatttgtttagtttttttaaatgttttgaggttgataagtgttatttattgttaaatggtattttggttttgtaggaagtagattttttgaaaatgaagtgttgttttgaaaataagtgttgtgagtaaatttattatttttgttgatatgtgtgatatttataaatagaagagttggtaatatttgtttgtttatttttttttttgaaaaatgaatataattttttttagtttgttagttgaatgaaaggatatattagtattttgttttatttagaaataaaaagttaaaaattattaagtaagtgtttataagattatatgaaaaagagaaagtagtatttagtttttatttttggtgttttaaatagaggatttattatagggagtgggttggggtggtatttgaggtgtatatagtgttatatattgtgttttttttatatgaatgtttgatgttataagtgtgatatgttttttgtttgtatgtagtgtagtgattgattaaatttaatttggttttttttatttgtttatttttgtttattagattaataaattattagtaggttaagaaaaaagaaaatagtaattaaaagttgtattgttaagttgtgttttttgtgtttatagtagttttttattaaatttgggattgtgaagggattataaagaaggtgattaatatagttttttttaaggttatgtgatttttttttattttattttttttttttttattttattttattttattttagatgaaagtggaaagattatggtaatatagaataagtggttattgtagtgttttttttttttaaaagatttaattgttgttgaggtagaaattgaatgttggtgttttttagttttttttggtagatttttgtgaggatgtttttttagtttttttttggaatatataaagggtatagttatgatgtttaattgttatattgtgtgggttgtttttgttaatagtgtagaggtaatttgtttttatagtatattatgtttgttttaaaagaggatgatgatgattggtgagtttttatttttagggttttttaaattgtaattgaggaattaaggtgttgtttttttttagagtggttattagttattgttgatttaaggtttgatattatggtggttggttagtaaatttaattgtttgttgtttagagaatgttagggtaatgtatgtttatttattaattagaaaaaaagtaggaatggataaattttttttgatagtatgttatttattagttttaaaaattggtatataagaaaaatagagttagggggatttttttttaaggtataaatgaatttattttttagatattggtaataatagttggtatttttagagtgtttattagatgtttaggtattttttgttaatatttttgttttatatttgagaaaattaaggtatagataagtaatgtgtttaaaattatagggtgtgtgggattaggatttgggttgggttggtattggtgttaatatttgtgtgtgatttttatattattgtgtagaggtagtgtgagagtaggggtagagttgataatgagtttttttaaatttatttttttttttttgtatttattaaagtatattttgagatagtgatttaagtttggtgttaattgtttaattttaatattaatttgtattgattaaatatttgatggtgggttagttaagtagagaaaatttaatatatatgtttttgtaaggttttttttttatataaatttaatttttttttttttttttttttttttgattttttatggttttggaatttgttggggtttttgtgagttggtttgagttgtaaagttttttttttttttgtttatttaataaatgtgtagtattttttaggatatgggtggtaaagtggagataataaatatttttgataaaagtgttgttagtgagaggatgatttttattaaatgttgtatattgttttataagatggtatgtgaaaaagatttgggggaagaggtaaatatttatttttgtagtagattgagtttttttaagaatggttagtttaaaatagtttataatagtttttatattttaatagatttgattttttatatggttttattttgtttgggtggttaattgatataatttatattttttttttttttttaggttattatagtatattatttagtaaagtatgttttaaagtttgtttgtattatatgattaaatttttatttattagtgtttgaaatattttagttgtgaaggggtttttaaatgttattatgtgtgatgtttttgtgtaaaagtagtaaatgggagaaaaaaattttataagaatgggtatttatatatttatatgaatgtatatatatatatatatatatatatatatatatattttattttgggttttaattataggttattgtatattttaaattttttgtaaaaggttttaaatattttttttttttttgaagattgagtgagttgtaaattttgggaataaatatatatataaatgaatggattatagtttgaaaaatataattatggtagtattaagttatgagattttatattggttttgtttagtttgttttgggttttgtgggaaaagtggaatgtatgaggttattttttttttaatttttaatttttaaattgtgggttttatatatttaagtagtaggtttatattttttgattaggtaataggttatgattttgagattttttgtggagttttggttataaaggaggatgtagtatgattaaagttatgggtagatgaaagagagatgagttaaagattagttgttttgtgattttgtttttttatttaatatttaaattttagaaagttattaagttgttaggtagatatatattttgtttgtttttagatgatttattttttattttgatatgaggtgtggatttaggtgattattttgaaatagattatggtataaaagttagtaagtatattttatttttttttatggttaaaaaattgatagaatttagttaagttggtaaattttttggattgtgttgtaattatttaatttttaattgtttgatttttttatattatttggaaattaaggtatttttaaatttggaaggaaatagaatttttaggttatgaatttaataaagattttgtattag

SEQ ID NO: 428 - DNA, 4343 bp, Artificial Sequence
  chemically treated genomic DNA (Homo sapiens)
tttaaagaattattaaattattttttgggtttttgaattagatggagttgaattattttggttgttaattgagtgaagggtgttggggaaaagtgttattgtgtaagttaaggaaagggttagagaattgaaaagatggtagttgtatgaaagggtttttgtgttgggattttttttttaagttatttaaaggtataaattaagaattgtaattttggagatatgataaatgaatataattttggttttttgttttattttaaagtgaaattttattgttttttaagaatttgtatatgaagttttatatattttttatgttagtttttttttttgttatttttgttttttagtttgtttttttttaatagttggatatattattgttttatttttttattagttgtgattgaagtagtttgaggttaattatttttttagtaattgataaagaattttgatgaagaggaaagtgatattgttttttgaataatattgtttttttttttttttgtttttttggttgagaggagagagtagggtagattttttttttgtaaggagtttagtagggtggtggtggtggggtttgtggaagtgtgtgggtaatatatggtaagtggagaaaatatttatatttatggtgaaagagtaggagaagatttaaagaaggttattttatagagattttaagtaagagatattgatttgatattgtatttttgatttggatataatagagaatttaaagaaagagtttttttttgtggtttttttgttattgttatttttaataatttgaattattggtaatttaaaaaagaaaagattttgtttattaaatttgataaaagtattatattggtttttttttgggttttggttaggttgttatgtttttttttttttttttgtgttaggtttttaaatttagaatttggagttgtggttattgagtttgtgttttgggtttgtgggtggtgtttgttgttgtgattgggtggttaggtgagatggagtgtatgggtagagtgtgtatttggggtgattggtttttgggggaagatataaataatgaattggtgttagattattttttgatgagatatatgaaatttttagtgtttttagtaggtattttgtattatagttttttaagaaaggtaaaaggtttttttttggttttttagtggtaaaatttgtagttgttgtttagtattataattaaatgtgtgtggggttgtgggatagaggtgtttttgtgtatttttggatagatttatagttgtttggtggatatatatgtgtgtgtttggttgattggattagtagttgtttgtgtttttttttttgtgtatggtggtggttttgtattaagatttgttgaggaaatgaagagtagggttattttttattttgttgttgaaagtttattttattttttgggtgtgtaggaagagatggtgtgagggtaggaaggtgtgaaattggggttttgtgggagatttattgtggttttatatttatttttgtttgaaaattgttagtgttttattttttttaaattttagtttttgagggggaggtagtgagatgggatataggtgtgtttgggtttttgtttgggaggggtttttttattttgggattttttgtggagtagtttataattgattggtttgttgtatagaggttatgtttaatggatttttgtagataaaagggtttggttattttttttttttataatggtttttgaggttaatgttttaaagaggaaataaagggattgttttatagtatataaggggggtggtgggaggaatagggagaggaggaggaaggggtattggatatgtggagtgggaggaggttttttgttttttaattttttattttttgtgattgtttaggttttttgagttttgtatttttatttaggatttgaaatagtggggaggaggtgatagtgtgtggagggttttgttttgtgatttgatttttagttttttttatttttttttttgtttttttaaagaatttttgaaagggagaatggaaaagatgaggggatttatattttgtgagttgtagttttgaaaagttagttttagaggggttgttttttgtgaggtttgggtgtttatataggattgatgtgtggtagtgttatttgggtttggattttgggattgtgggaggtgggagtgtttggggttaggatttgggtgtatgttgagggtatttggtgaaggttggggaaagtggggtagttttgaaatgtggtttgtatgttgttttgggagttgtttttgggtttttttgtagatatagtttttaggtgtgagtggtgtgtgtgttggttgggggtgttttttataggaagtttatatttgtaaattgggtggtgggggggggggggggtggggtgtggtgggagagagagagttttagtggtttttgttttttggtttttttgttttggttttaggaaaagattaaaataatagttaaatagtaattgaagataagtgatgtaagaaataaataatttgataataaaaatgtttatagggatggttttttaaaattttttattatggaaattagagtatatgtataaaaggagagagaaaggtattgtgtagtgggttttaaatttgattaagtatttgaattgtggagtgaaattttttggagggtttgttaaaatatagattgttgggttttagttttagagttttttgttgtgtatttttaagtagatttggggttagtttttttttgagaatttgtaatttgttagagtttttaggtggtgttgtttttggtttggaaaggatattgttatttattggtttaataaatttttgtgtatttttttttatttttaatatgtataatatttttttattttgtttattttatttttttttatattttgtttggtttgttggagaattataaagtaatttttagttattttattattttatttatatagatgatttttgatttggtggttatttaagttgagaggattgtaggtttttttgtggttattttatattggggtagaatttggtatttttttttgggaaatttatgtttatattttggttttgagattattttttgggagtttttttttagtagattgttatatgtttaaatattattattgggtttgttggtaagttggtttggtttggttagggtattatttggtttttattttttattttttgtttattgtttttaatttgttattatgtatttttataattattgttttttttgaggtatttttttaataaggtgttttttttttagggtggagttttgagtgtttagggatggggtggtatttataatagtgtaagtttataggattatttgtattagttaggtttaggatttatattttaaggggagtttttttgggttatttgattttttgtataatttttgattggaaaaggggatattttaggtatagtttttgggaatggttattattgatatttgttgtaattttttttgattgttgggttttagtttagtttggttatttgtgttgtttttgttttagagaggtgttaagtgtttttttagattttatttggttagttttaagtgtgtagtttttatttatttttttgttttttttttgggttgttttgaaataagttttttttttttttttttttttttttttttattttggtttaggatattatttgttttttttatagtttttttattttagttttttttagttttatttttattttaatttttagaggttttttgggttgttataaagtttagatatttttttttattttttaaatttttagagatggggtgttatttattgtgttatttaggttggagtgtagtggtgtgaatttggtttattgtagttttaattttttagatgtaagtgatttttttattttagtttttaagttattgggattataggtatgtattatataggtttgttaattgttgtatttttttttttttttgtagagatagggttttgttttgttgtttaggttggttttgaatttttgagtttaggtaatttgtttgttttggttttttaaagtgttgggattataggtatgagttattgtgtttgatttagatttttttattgttttttttttttttttgattttttatgaagtaagtatattatatgaattttttatttttttatttgttgttaaagaaagttttggggatggagtaggtttttttattttagagttttgtttttatttttatattgttttatttttttatgtttttttttttttattagtttggaa

SEQ ID NO: 429 - DNA, 4343 bp, Artificial Sequence
  chemically treated genomic DNA (Homo sapiens)
ttttaggttggtgaaggaagaaaaatataggaagatgaggtaatatgaaaataggaatagagttttggggtggaggaatttattttatttttggggttttttttaatagtagatggaaaaatgaagaatttatatagtatgtttgttttatgaagagttaggaaaagaaagagaataataaaagagtttaggttgggtatagtggtttatgtttgtaattttagtattttgagaggttaaggtaggtggattgtttgagtttaggagtttaagattagtttgggtaatagggtaaaattttgtttttataaaaaaaaaaaaaaatataataattaataggtttatgtggtgtgtgtttgtagttttagtgatttaggggttgaggtgggaggattgtttgtgtttgggaggttgaggttgtagtgagttgaatttgtattattgtattttagtttaggtgatatagtaagtgatattttatttttaaaagtttaaaaaataaaaaaaaatgtttaaattttgtaatagtttaagagatttttgagggttgaggtggggataggattgggaggggttgggatgagaaagttgtggaaggagtagatggtattttaaattaggatggggaggggaggggagggaaagaagggaagtttgttttggagtggtttaaaggagaggtaaggagataggtagaggttgtatatttaggattagttaggtggagtttaagagagtatttggtatttttttggaatagaagtaatatagatagttagattgagttagggtttgataattaagggaggttatgatagatgttagtgatggttatttttagaagttatgtttagaatgtttttttttttaattaggaattatgtggagggttaagtagtttagagaagttttttttggggtgtgagttttggatttaattgatgtaaataattttatgggtttgtattgttgtgggtattattttatttttaggtatttagaattttattttggaggggagatgttttgttaggaaaatattttaggggaaatgatggttgtgggagtatatgatgatagattggggataatgagtagaaaatgaaagatggggattaggtggtgttttgattaggttaggttagtttgttagtagatttagtggtgatgtttgggtatgtgataatttgttggaaaggaatttttgaagggtggttttagaattaagatatgggtatggattttttagagagaggtattagattttgttttaatgtgaaatgattataaggaagtttgtagtttttttggtttaagtaattattgaattaaaaattatttatataggtgaaatgataggatggttgggaattgttttataattttttagtaaattaaataaaatgtgggaggggatagaatgaatagagtggggaggtgttgtatatattgaaggtgggagagggtatgtggagatttattggattagtggatagtagtgttttttttaaattagaagtagtattatttgagggttttaataagttgtaaatttttaggagggagttgattttagatttgtttaaaaatatataataaaaaattttagggttagggtttagtaatttgtgttttaataagttttttagaggattttgttttgtggtttggatgtttgattaaatttgagatttattgtataatatttttttttttttttttgtgtatgtgttttgatttttataataaagggttttaaaaaattgtttttatgggtatttttgttgttgagttgtttattttttatattatttgtttttaattgttatttaattattgttttgatttttttttggagttagaatagaaaagttagaaagtagaagttattgagatttttttttttttgttgtgttttgtttttttttttttttattgtttagtttgtaaatataaattttttgtaagagatgtttttggttggtgtatatattgtttatatttgaaggttgtgtttgtagaggggtttgggaatgatttttagggtgatgtgtaggttgtattttggagttgttttattttttttggtttttattgggtgtttttagtgtatgtttaggttttggttttaggtgtttttgttttttgtagttttagagtttgggtttaggtggtattgttatgtgttgattttgtgtgggtatttgggttttgtgagagatgatttttttagaattgattttttagaattgtagtttatgagatatgggtttttttattttttttgtttttttttttagaagttttttaaaaagatggggaaggaggtgaggagagttggaggttgagttatagggtggggttttttatgtattgttgttttttttttgttgttttgggttttggatgagggtgtggagtttgggagatttgggtggttgtaggaggtgaagggttaagaagtgggaggtttttttttgttttgtgtatttaatgtttttttttttttttttttttgttttttttgttattttttttgtgtgttgtaaaataatttttttgttttttttttaagatattagttttaggggttattataggaaagaaaggtagttaggtttttttatttgtgagaatttattaagtatggtttttgtatagtaggttggttggttatgggttgttttatgaggggttttaaagtgggagaattttttttaagtgaggatttagatgtatttgtattttattttattattttttttttgggaattggaatttagggggagtggaatgttggtagtttttaaatgagagtgaatatagagttatggtgggttttttgtagaattttagttttatatttttttgtttttgtgttatttttttttgtatatttgggaaatgggataaatttttgatggtaagatgggaaatgattttattttttgtttttttagtgggttttggtgtggggttgttattgtgtgtgggagaggggatgtaagtagttgttggtttggttgattagatgtgtatgtgtgtatttgttagatagttgtgggtttgtttgagggtatgtgaggatgtttttgttttgtagttttgtatgtatttgattgtggtgttgggtgatagttgtgaattttgttattgggggattgaaagagggttttttattttttttaggaagttgtgatgtaaaatgtttgttgaaagtattggaggttttatgtgttttattagaaaataatttaatattgatttattatttatatttttttttaagaattagttgttttaaatgtgtattttgtttgtgtgttttgttttatttagttgtttagttataataataaatattgtttgtaggtttaaggtataggtttagtgattgtggttttgaattttggatttggggatttggtgtagggggaggggagaaggtgtggtagtttggttagggtttggggaagggttagtgtgatatttttattaagtttagtgggtggaatttttttttttttaaattgttaataatttggattgttggaagtaatggtggtaggaaagttataaaagaaaattttttttttaaattttttgttgtatttaggttaaagatataatattaagttagtgttttttgtttgaaatttttgtggaatgattttttttggatttttttttgtttttttattatgaatataaatattttttttatttattatatgttatttatgtatttttatagattttattgttattgttttgttgggttttttgtaaaaggaaagtttgttttgttttttttttttagttgggagggtagggggaggagggagtagtgttgtttaagggataatgttatttttttttttattaagattttttgttaattgttggggaaataattgattttaagttattttagttataattaatagaaaaatggaatggtgatgtgtttagttgttaaggggaggtaggttggaaaataaaggtggtaaggaagggggttgatatgaaaaatatgtaaagttttatgtgtaaatttttgggaaatagtggaattttattttaaaataaaataaaaaattagaattgtgtttatttgttatatttttaaggttgtggtttttgatttgtgtttttggatagtttaaaaggagaattttagtatagaagtttttttatatagttgttgtttttttggttttttgattttttttttaatttatataatggtatttttttttaatattttttatttagttagtagttagaatgatttagttttatttgatttaggggtttagggaataatttggtagttttttgag

SEQ ID NO: 430 - DNA, 4476 bp, Artificial Sequence
  chemically treated genomic DNA (Homo sapiens)
tttttaatttttattttaagaagatttagagtaataatgtagaaaataagtggtttgaggaggattgggagttagggtggaaagttagtagtatagttaaggtgtttgttagttttttgtttggtttggagaggaagaagattattttaattttttttatggtgagttgtattttttgtttttttttttttttttgtggtggggtttgttttttttaggtagttttttttttaatttagattttgttttttttggttattatttttgtttatagtaggaagttttgtttttagtagtaaatgtagaattttttttttaatttattattgtttgttttaggtggaagggataggaagtttgttttatgaatttggggggagaatttggttgtagattattttggttttttgatagaatgtttgttttttattttttatagaatagtgttttttttattagtataaattgaagtaggaattttttatttttggagtgggttagttttggttaggtttttatttagaatggtaaagataggtgagagatttgggttttgtttgttttattttttaggagttatgttttatagggtgatgtttgttagtagtattgttttttgtttttgttagtgtattgttttttgttttttggagttttattttggttgtgtttagtttagttttttttttttttattttatgttattgttttttttttatttttttttgattgttatttgtagtttgttaagtgtggggttgattgtggttattttagttatatgtttgttttttgattatggttagggtatggtagttgtttttttttagatatgagtagttaaggttttgtgttgggggttttagtttagggtagaattaagagatgtttattttgaggggtgtatatatagagggtgattttagttatttttatgagattagagttttttagtttttattggttgtattttttggtgttgtatttttggttttattttttttgagtttatgaaagtttttttttagtaatattttattttttttgtagaagaaatttttttgtttttaaaatttttaggaggttagtgtagtttggaggtagtggttttttgtttgtttttttttatttttgatttttttttttaggtattgatttattttgttgttttttgattttatttatttttattttttagttttgtattttttagttttgatttgtattttgttgttgtttaggtttgatttttattttgttagagttttttagttttggttttttttttgtttttgttttttaatttaggttttttgtttttatttatttttaatatgggtttttttgttgtttttgttttttagtttaattatgttagggttttgggtttttatggtttttgtttttgttgtagtttttgtggtttggttttgttagtattagaaatttatgttggtttttgtgtattttaataaggtttttgggttgttttttatggagagtaattgtgaggtgttgtggtttaggtaagtgtgttggggtagttggtgtatttgttgtttttagtttattttatttttttgttttaataattttttttttttatttgggggttttgttgtgtttttgttattttagttataagaaatgggtttgttttttgtggttaggaagtggagggaataaaaaagagtattaatgttttttttttttagtttttttttttagaataggtatgtaggaagttgttttaaggttttaaagggaaatttttttgttttgaattttttagggtttttttagggattttggggatagttggtattatagggatttaatttttaagggttggtttttattgttgttttgagggtttagtttgtttggtttttagggagtttgttgtttttagtttaaattatattttatataggggtttttttttgtttttttttttttttttttaaattatttttttttatttttatgagattttttttttattattgtttttagtagttatatttttttttttgtgtttttgtgatggttgtttttgttttagtatttttttttttgtttttattatagggtgtttaggtgtttagtgatggttgttttgtattttaatttgttttttttaattttatttttttttttatagtatagttttttagtgtgtttttgttgtttttttatttgtttataatattagtagtagtggtggagttttagattgaattaattttttttggggtgtgtttagttgaagtattttttatgttgggtagttttgataggtgtgggattagtagaatttgttttatggtgtgattttagtttttttttttggttatagttagggttggtggggggtttttgggagtatttttagtaagtttatttttaagtttgtatgtaggtaagtaaggagttttgggtggtagagaggtttaggttaggtttttttgttttatttggggtgggttgggggttgggggttggggtttgggatattttgtattggtattgggttttggggttagaagaggttttaggaagtataagaaattaggtttttgttaatattttatgtgtttaggtttattttttttaggtttttttttaattttttataggtattttttattttttggttttaagtagatggttgatgttgttttttttttaggagagtgtgaatttagatgttaaaataaaagttttttttttttttttgggtttttatggaaatttatatttggtgatgtagttgtaaagttatgaggtatgagttaggttggggttagtaaggaaaattttgttttggttttttgtttttttgattgttttttttattagttggttttgtttttggttgtaggtgtagttatgtttttttgtttgggggttttagggtgaaatttataaatgaaattattggtgagggtttatagtggttttttttttaatttaattttgatgtgttaaaggttttttgtgttggatttagggtggggatttttttatggggttttttatatttgagtttttagttattatagaggtgtagtttgaagtgtatttagttaattggttggttttttgggatgttttgtatttttattttgttatttttttttttgttttggagtagtagtttaggaagtagtaggggttttgagagaataggtttgtttgttttttttttatgttttattttattttgttggaggagttaaagttattgttttatttgagttttagaatgtaagtgtgaggtttgtagagagtgtgggtaggtttgaaagtttgggattttagttttgttgagtggtttttttgaaaatgggatgatttttgaatttgtaaagttattttttttatttgtttatttatatattgttttgttggttttttttttatttttttttttattttgttttttttttgtttgtttttttagaaatttgttttttaggtttgttagaaggtaggtgttgagtttgttgtgtgtgtgtgtgtgtgtgtgtgtttgtgttttgtgttttgtttttattattaattttttttttttggtttttatttttttttatttgtttaattaagtttgtgtggtttttttttttttgttattttaaagggatgaagattgtttttgattgggtattagtataaggtttgttttttgtgtttttagtataaataggtagggttaagaggttatattggtttatttagggtaaatggttttaaaaatgagggttttttttgggtttatagttaatgtttgtttttaagtaaggggagattgttttagggaagtttttttttaagattgtttttttttatttattttattttatttttatttttttttattttaggttttggttataagtgttgggatttttttttgtttttttttttgttatgtgtatgtgttatgaggaagttttagggttataagtgtatttgggatggtattttgtttgttgttttttgggttttttgaattttagagttatgtgattttttttttgtggtttatgggattgtaggattttggagatattatggggattttggggttttaaggttttagtttggtttttttagattttaggagtttttgttttataaatggagtatagtatttttttttggtagtttttgtagaattagttttatttatttgtatttttgttttagtatttttgttattagtagtatttggataaattaagtttttttttttttaggttgttttttttagatatggtttgttttttttaaagtgtggggagttgggatattttagggtaatggttattttattttaagttgtagtaaaataataggagatttttgtatttttatttaggggtttttttttatagttttttttttggtttttttatttttggttttatgtttattttttttgtaggttttggggattaaatattaagttga

SEQ ID NO: 431 - DNA, 4476 bp, Artificial Sequence
  chemically treated genomic DNA (Homo sapiens)
ttagtttggtatttggtttttgaggtttgtagagaggatgagtataaggttaggggtgaaagagttaggaaggggattgtgaagggagatttttgagtaagggtgtagagattttttgttgttttgttatggtttggggtagaatggttgttgttttagaatgttttagttttttgtattttggaagagataggttatatttggagaaaatagtttagaggagaagaggtttgatttatttagatgttgttggtggtaggggtgttggggtaggggtgtgggtgggtggggttagttttgtaggagttgttaggagggggtgttgtgttttatttgtgagataaaagtttttaaggtttgggggagttagattgaaattttggggttttagggtttttgtagtgtttttaaagttttgtgattttataggttatggggaagaggttatatagttttgaagtttaggaaatttaggagataataaataagatattattttagatgtatttgtaattttggagtttttttatagtgtatgtatatgataagggaaagggtaggaaaggattttaatatttgtgattaaaatttggggtgagagggagtgggggtggggtggggtgggtgagaggagataattttaaagggaggtttttttgagatagtttttttttatttgaggataggtgttaattgtgggtttaaggaaggtttttatttttaaagttatttgttttgagtgggttaatgtggttttttagttttgtttgtttgtattgggggtatggagggtaggttttgtgttgatgtttaattagaggtagtttttatttttttaagatggtagagagaggagggttatatagatttggttaagtagatggaggagagtaagagttagaaaaggggagttagtgatggaggtaggatataggatatagatatatatatatatatatatatatagtgggtttaatgtttattttttggtaaatttgaaagatagatttttaaaaaaataaataaaaaaaagataaaataaaaaaagaaataaaaaaaaaattaataagatggtatgtggataagtaggtgggggaggtggttttataggtttaagggttattttatttttggaagagttgtttagtgagattagagttttaggtttttagatttgtttatattttttgtaggttttatatttgtattttggggtttggatggggtagtggttttggtttttttagtagagtggagtgaaatgtagaggaagggtaggtgagtttgtttttttaaagtttttgttgttttttgagttgttattttaaggtagggagaggaatggtaggatggggatgtggagtattttaggaggttagttagttggttggatgtattttaagttgtatttttgtggtggttgggggtttaggtgtgagaaattttgtgaagagatttttattttgggtttaatataggaaatttttggtatattggagttaggttagggaagaggttattgtaggtttttgttagtgattttatttataggttttattttaaaatttttgggtagaagggtatggttgtgtttgtagttagaaatagaattaattagtgggagaggtagttaaaggggtaagagattaggataaaattttttttgttggttttagtttggtttatgttttatgattttgtagttgtgttattaaatataagtttttatgggaatttaggagagaagggggggtttttattttagtatttgagtttatatttttttagagaggaggtggtattggttatttgtttggggttagagaatgaggggtgtttgtgaggagttggggagaggtttaagaggggtgggtttgggtatataaggtgttgataaagatttaattttttgtgttttttgaagttttttttaattttaggatttaatattggtatagagtgttttaaattttaatttttaatttttaatttattttgagtaaagtaggaaggtttggtttgagtttttttgttatttaaagttttttgtttatttgtgtataaatttggaggtgaatttgttgaagatgtttttagaggttttttgttggttttggttgtggttagagggagaggttggggttatattgtagggtaaattttgttggttttgtatttgttggagttgtttagtatggaaggtgttttggttggatatattttgggggaagttagtttggtttggggttttattattgttgttgatgttgtgggtggatggggaggtaatagggatatgttggggggttgtgttgtgggaagagaagtggggttgagggggatgaattagggtataggatagttattattgggtatttggatattttgtggtggggatagggagggggatgttagggtagaggtagttattatgaggatatagaaggaagggtgtgattattgaggatagtggtgagaaggaagttttgtggaagtggaaggagatggtttgggaagggagggagggaggtaaggaaggatttttgtgtggagtgtggtttaggttggagatagtgggttttttgggagttgggtagattggatttttaaggtggtaatggggattaatttttgaggattgagtttttgtgatgttgattatttttggggtttttaaggaaattttggaaggtttagaataaaaaggtttttttttggagttttaggatagttttttgtatatttgttttgagagggagaattggaaaagaggggtattaatgtttttttttgttttttttattttttggttgtaggggatagatttattttttgtggttaagatgataagaatatagtaggatttttaagtgggaagaagaaattgttggggtaagggggtagggtgggttgagggtagtaggtgtattagttgttttagtatatttgtttgggttgtggtattttatagttattttttgtggggggtagtttagaggttttgttggggtgtatggaggttgatatggatttttggtgttggtggggttgggttgtagagattgtggtagaagtagaagttgtggaggtttgggattttggtatggttaggttaggaaataaaagtagtggagaggtttgtgttaggggtgagtgagggtgggaggtttggattaggaagtaagggtaggggaagggttagagttggggagttttggtagggtagaagttaggtttgggtagtagtgggatgtaagttagaattgaggaatgtggggttgagaagtggaggtgagtgaggttgggaagtagtgaggtgggttagtgtttgggaagaggaattagaaatgaaggagagtagataaggggttgttgtttttaggttgtattggttttttaagaattttaagaataggagagttttttttatagaaagagtggggtgttgttgaggggaaatttttataaatttagaagagatagagttaggaatgtaatattaagaaatgtggttggtgaaggttggggagttttggttttatggggatggttggagttgttttttatgtgtatattttttaaggtgggtattttttggttttgttttgagttgggatttttaatataaggttttagttgtttatgtttagaggagggtagttgttatgttttggttgtggttaagaagtgagtatgtagttgagatggttatggttagttttatatttggtaaattgtaagtagtagttagaggaagatggggaggaggtaatggtgtggaataggggaggggaaagttggattggatatagttaggatggaattttagggagtagggagtaatgtgttggtagggataggagatggtgttgttgatagatattattttgtgagatatggtttttagggagtgaggtaggtagggtttgggttttttatttgtttttgttattttggatggaggtttggttgaggttggtttgttttaaaagtggggaatttttgttttgatttgtgttggtggagaggatgttgttttgtggggaataaagggtaagtgttttattagaaagttaaagtggtttatagttaggttttttttttaggtttatggaataggttttttgttttttttatttgaagtagatagtggtaggttaaggaaaggattttgtatttattgttgggagtgaggttttttgttataagtagaagtagtagttaaagggaatagagtttgaattaagagaagagttgtttggagagggtaggttttattgtaggaaggaaggagagagtggggggtgtggtttattgtggagggggttggggtggttttttttttttttagattgggtagggggttggtaggtattttggttgtgttgttggttttttgttttgatttttggttttttttaggttgtttattttttgtgttgttattttgagtttttttagagtaagaattagagg

SEQ ID NO: 432 - DNA, 6435 bp, Artificial Sequence
  chemically treated genomic DNA (Homo sapiens)
atttttttttttatttttttatagtttttgaatttgtgggatagattgtggtagtaatggtaaattgatttgtaattagttttaggtgtatatatatatatatatagtttgttatatttttttagttatagttatttgttttttttagtttttgttgtagttttttatgtttgtttttgtatatataattgtatttttttgtatttttggttttggttattggtttggttttttagttatttttttttgtataattaagtttgtatttatatagttttatagttttagttgatattatagttttaagtaaatagttttgtatattatttattttttaaatgttgagttgtttatagtgaggtttgttatttatataatttttgttataatttttgataatttttattgtagttttatgtttatgtagttttttatatgtggttttggttatttagtttgttttgtttgttattaaatagtgatagggttgtagtttttgttttttttttgtagatattattttgtgtatattattataggtttttgtatagtattttgattatttatttaggtttagttattttttgaaatatagttataattttttatatagatatattattaaaagtttgtggttataatttttgtatatttttatatataattatagttttttatgtttttgatatatatatggttattgatatgtagtttttattattgttttttatatatgttattatattgttttttttataattgatttttgttttatattttttatatatagttatgtgtgttatgtttagttagttttgataatattagagaaaaagtgttagtagtttttagtattattttgaaaaatatatatttataggaataattttttattttttgggattttttagaaaaaaaaaaggtttattttggggaagtaaaataaatagtggagatgagtgtagtattgttttttaaattattaatttttaggttttaaggtttgggttgggttagtgttaataggtgagtttaggagttttttgaatttatttttttttgtttagaatagagataggataggttttatgttttttattttttttttttaattttagggatattgaaagggttttttgtatttgtttgtaggaaattggggggttgggagggagggaattgaaaatttatgtttggtattaaaaataaatatttggagtgggggaggtggtaggaagatttttttttaaatttttttttttttatttattttattaaatataggaagagatgatttttttttttttattgaaaagttttatttaaaaatagattatattattaaaatggtagtgggggagagatagggagatttggagtattggttggaggggttttttagatggggattattttttaaaaaaattttttattgggaggaaataggtaggattttagggaggttggtagataaaggaatggttttttagggggaagaataaaagggatatttttttttggttaaaaagttggttgaaaaggataagttgtttgagagaaaggttggggaggtggaaatttttattttaagggtgtgatttttttttggttaagatttttaatttattaaatggtataaattttttttggatttttgagtatggttaggaataataaaataaaataaattaatttttttatttatatttaaaaatgtagatagggtttttttatttttttaagggtaggttgagaaataaagaaagaaaggttgtttttaagttagattttgattgttttgttttggggaaaaaagtggggaggtgggggagatgttttaattattttaaaaggttaggttaggttttttttagtggtttttaaaaaataaataaataaattgtttttattattgaagtaggagatgtgtaagggtggttattgggggattgatagaaaatagagaagttgtggaagttgtgtgttttttgtggaggagataatgagagttatttttgggagtaattttttttaaggatttttattttattataattagagtatgagttttttagttgaattatgtttttttttgagatggttggttggagagagtatggatggagtgattttagaaggggtggtggtggtggtggtagtagttatggtttttggggttttggggagagtattatgggggttgagaggttatttatgttgatagaagggatgtgtatttgggtgttgttattggatggaaattgggggtaaaaagagggagaggttatagatgggggttatttttgggttttttattttgtttaaaatggggaaagaggattttatttggaaggagagtttggttgggttatggggtgtaatgggatttagggtgttttagaagtgaatgttaggaggtagtgagttgggtgttagtagtattggggtttgtggggagagggtggttggagtttaagtgagtagaaagtagatgtgggatgttggaagggatttggttttggttttattatagattttttatttatatttttagggttattttttaaagtgtatatatttagatggtaattatggaggttatgtttatgattttttaaattttgtagatattttttattttttatttttgagagtttatttttagttgttgagattttattggttaagattatttataagattttatttaaatgttgtttttaaattttttaagttattattttaatagtttagggttaatttttaatttatgttttatttatgaaattttatatgtatattttagattaaaaagttttgtttaggttttttaagttatattttaatttagaaatagttttatagaaagatttttggttttatttataaaagtttttagttttgttttttattaattaaattttatttttttagttagtattagtttagttaattatatttaaaggttttattttttttaggaataattatatttatttttttttgatttttgttagttatttgttatatgttaattttattggtgttggtgtttatatattttatttttttgtaggtatttattaatgtatgtgtaggaagtagggatggggttagtgttggttttggagtttggaggttggagttattttttgattttggggtttgtttgggttttggtttatttagtaggtttgggttgagtggaagttttaggttttggggtttttggtttttttgtggttgggagattttagggttggaagttgtatggttgtttgtttgttttgtggtgtttataataattgtgggtagttgggttggtatgtttttttgtggagggatttttggtttggttttggtggtttttggtataaatttttttttttttgtaatttttaatttttttttgggtttttttatttttatttttgggggtaaagtttggtttaaatttggttttatattaagtttttttgattttaggtttggggttttgggtggggttaggatgatttggtagaggagtaggtataaagagggtgtgtaaggattgttgggattataggatttttttgtgggttatttagtgatttttttgggaaggtggtatttggtatttagggtatgattgtatattagagtaagttttttaataggatataggattttgttaaggaagtagggttttttttggggtaggtttttttatgggataggggatttggggtgagataatttgaagtgggtaggaatttgagggatattatttttatttattaaaatagtggtttttaaaaatttatttttttttggattagtaatatttgttttatttggtaataagttaaaaatgtaaattattgggtttttttttagttttataaatttagaaattttgggggtgtgtttggtaatttgtggtttaataagatttataggtgattttgatgagtattagagtgtgagaattagtgtattaaatatattttaggtatttatatgtttggtagttattaattgtagtatagtatttttttttttttgttttaggatttgtgtagttttttgttttatttttttttttaagaggatgttttttttttattattattttttttaatgggatagttatgttttttttattagttttttttgttatttggggattatatattttttttttttattgtttttttttattgaatttttatattttagtttttatttgtagaggtaagttggtttttttagtttttagataggtttttaaggggtttggattggtgtttttgttttttgaggggggtgttgttgtttttgtaggagttgtattggggagtattatagtaggttgaggatgagggggtggttgtggttgtagagattggatggtgaaggtggaatagaggtttgagtgtatgtatttgttttggttgttgtgtgttaaattgtttgggtttgttatttttgtatttttgggtgtgtttggttttttagagatagtgttttttggggtggtatgtatagtagtaggggttatatttggtatggtggaggtaatagatatttttggttggggtgggtagtttttagtggagtattttgtgattttagggtaggatataaatttgtagatgaatttttggttgtttattttgtggatgatgttttaggaagggaggagaggaatagagggttttagaggaaaggggtaggttggaggtagggtgttaggggggaggaggggggtggagtggtatttttttttttttagtggttttttttttatttgtttttttttggtttttttgttttttttttgtaagttttttttttagtttatttttttttttattggtttttatttttttttttttttgttagattttttttatttatatttttttttagtttttttttttttttttttttttttataataattttttttttaagtttttttttatttatttttttttaagtttttttttgttattttttaggtttgtttatttgatttttttattttttttatattgtagtttttttttataatggggtttatgaagggtagtaggtgtgggagtaggttttttttttggttttaagaattagaggtttatagggttaggttttgtgggtgattgttaggatatagttttggagattagtaaatgtaataagataagaaaatgaagtaattgatataaatgttggaagaaagtaaattaatgtagatggatggggtgatgaattattaatatagaggattatttgaagttaatgatatagaagtggaatagggtaaggttattgtagaggagagggtgaggaggttttattattaatattattgtggaggttgaagttaaaatggtaagaaaatgaagtaattaatagtaattagataagaatattaaaaatattggtataaatattgggagggggtttatattaaggttggttttgttgggttatagagtatgtttggggttttttaggtttggtgggttttagagatgatttagtgtttttagagggtagagtgagatagttttattattaatattgttttggagggttgagtttaaggaataaaatatgaaaatggaataaatgttataaattatgaagggtgtgtagtatatgattagggtagttttgggagtgtggaggtattagggtattttgtggaagttttagtgttggttagatatgttatagggtgggtttgtgttttttggaagaggaataaaaagggatatttatgaatattgtttgggaaattttagtagaaggattaagaaaatgaaataattggtataaatattggggggaggagaaatttagtagtggtttgggggtttgagagggtaggatgggggaaattttaaattttagttgtaggaataagataatgaaaataattgatataaatattggggtagattagtgtttttttgggaatttaagaagatagtgtgtggaagttggtattaaatatgttgttttagaggttttagtttaaggaataagagaagaaaataattagttaaaaatgttgggagttttagaggatgaagtaagtaaaagttggtataatattgttagggaggttttgattttaggaatatgaaatattttggaataagagaagattatgaaataattagggaagtttagtattggtttaggggttttagaggatagaatgaggattagttattattaattgtgtttttaagatgttggttataggaatatggtaggaaaatgaaatgttgtgtatggtagggtagtattattttggggattttagagtgggagtagaaagagttagtattaataatgtagtggtggtttttgttaaagtagtaagataagaaagtaggtgagatagtgtttaggggtttaatattggttttagggtat

SEQ ID NO: 433 - DNA, 6435 bp, Artificial Sequence
  chemically treated genomic DNA (Homo sapiens)
gtattttaagattagtattgggtttttaaatattattttatttatttttttgttttattgttttggtgaaaattattattgtattattaatattgattttttttatttttattttgagatttttaaagtgatgttgttttgttatgtataatgttttatttttttgttgtatttttatagttaatattttgaaaatatggttaataatggttggtttttattttgttttttgaaatttttggattagtgttgggtttttttagttattttatagtttttttttattttagaatattttatatttttagaattaaaatttttttgatagtattatattaatttttgtttattttgttttttgggatttttaatatttttaattaattattttttttttttattttttaagttaaaatttttgaaataatatgtttaatgttaatttttatatattgtttttttaaatttttagaggagtattggtttattttaatatttatattaattgtttttattattttatttttatagttaaaatttaaaattttttttattttgtttttttagatttttaggttattgttgggttttttttttttttaatatttatattagttattttatttttttaatttttttattgaaattttttaaataatatttatgaatatttttttttattttttttttgagaaatataggtttattttgtgatatatttgattagtattaagatttttatagaatgttttagtgtttttatatttttagaattgttttggttatatgttgtatattttttatagtttatggtatttattttatttttatattttattttttgagtttaattttttagaataatattagtaatgaggttattttattttgttttttgggaatattaggttatttttgagatttattagatttgaaaaattttaaatatgttttgtgatttagtaaagttagttttgatataggtttttttttaatatttatattagtatttttaatatttttgtttaattgttgttagttattttatttttttattattttagttttaatttttatagtggtattaataatgaggtttttttatttttttttttgtagtgattttgttttgttttatttttgtattattagttttaaataattttttgtattaataatttattattttatttatttatattaatttatttttttttaatatttatattagttattttatttttttgttttattgtatttgttagtttttaaaattgtgttttgatagttatttataaggtttggttttgtgaatttttggtttttggagttaggaagaagatttgtttttatatttattgttttttatgggttttattgtgaagaggagttatagtgtggagggagtgggaaaattagatagatggatttggagagtgataaagggaggtttggaaaggggtggatgggaaggggtttaaagaaaaaattattgtggagagaagagagaaaggggaggaattggggagggatatagataaggggaatttggtgggagaggaaagaggtagaaattaatgggagaggaaatgggttgagagagaaatttatagaggagggatgggaaagttggagaggagtaagtgggaagaaagttattaggagaagagaaatgttattttatttttttttttttttttgatattttgtttttagtttgttttttttttttaaggttttttgttttttttttttttttttagaatattatttgtaaggtgagtggttagaagtttgtttataagtttgtgttttattttgaggttgtagggtgttttattgaggattgtttgttttagttagaggtgtttgttatttttattatgttaaatgtggtttttgttgttatatatgttgttttaggggatattgtttttggaaagttaggtatatttaagggtgtaggaatggtaggtttaggtggtttggtatgtagtagttggaatgagtatatgtgtttgggtttttattttatttttattatttagtttttgtagttgtagttatttttttatttttggtttgttgtggtgttttttagtgtagtttttgtaggggtagtagtgttttttttggggagtaggagtattagtttaagttttttggaggtttgtttggaggttgaagaggttggtttgtttttgtaggtaaggattggaatatagaaatttagtaagaggaggtagtaaagaggagggatgtgtaatttttggatgatgagggaggttggtagaagagatatagttgttttgttaaaggagataatggtggaaggaagatatttttttagaaggaggggtggggtagagagttatataaattttgagatagaaaggggagaatattgtgttatagttagtagttgttgaatatgtaggtgtttggaatatgtttaatgtattggtttttgtattttagtgtttattagaattatttgtaggttttgttaaattatagattgttaggtatatttttagagtttttgaatttgtggggttggggaggggtttaataatttgtatttttaatttgttattaaatgaggtagatattgttggtttagaggaaggtaaatttttgagaattattgttttaatgaatgaggatggtattttttagatttttatttgttttaggttgttttattttaagttttttgttttataggaggatttgttttagaggaagttttatttttttgatgaagttttatgttttgttggaggatttgttttgatgtgtagttatgttttgagtattaagtgttatttttttggggaaattattgggtggtttataggagaattttgtggttttaataatttttatatattttttttgtgtttgtttttttattaggttattttgattttgtttgaggttttaaatttgaaattggaagagtttaatgtggagttgggtttgggttgggttttgtttttagaagtgaaagtagaagggtttaaggaagagttggaagttgtgggggagagagggtttgtgttagaaattattaaggttgagttagaagtttttttataggagggtgtgttagtttggttgtttgtggttgttatggatattgtagggtaggtgggtggttatgtggtttttagttttgagattttttagttgtagaagggttggaagttttgggatttagagtttttatttagtttgagtttgttaggtgggttgggatttgaatggattttaggattgggaagtggttttggtttttaggttttggggttggtgttgattttatttttgttttttatgtatatattggtgagtgtttgtggaggggtggggtgtgtgggtgttagtattaatgggattggtatgtggtgggtgattgataggaattagaggagggtgagtgtggttgtttttgaagagggtggagtttttgagtgtgattgattgggttgatgttggttggagggatggggtttgattagtgaagggtagggttggggatttttgtgggtgggattgagggtttttttgtgggattgtttttaggttggggtgtggtttaaggaatttgagtagggttttttggtttgggatgtgtatatggggttttatgggtgggatatgagttggaagttgattttgagttgttgggatggtgatttgagaggtttgagagtagtatttggatagggttttgtgggtggttttgattaatgaggttttagtaattgagggtgggtttttgggagtggggagtggggggtgtttgtagagtttgagagattataggtatggtttttatggttattatttaggtgtgtgtattttggggagtgattttgggagtgtgagtgggaaatttgtggtggggttgggattaagttttttttagtattttatatttattttttatttatttgagttttgattattttttttttatagattttggtgttgttgatatttagtttgttgttttttagtatttatttttggagtattttgagttttattgtgttttgtagtttggttaagttttttttttaggtaggattttttttttttgttttggatagggtgagagatttaagaatggtttttatttgtgatttttttttttttttgtttttagtttttatttagtggtagtgtttaggtgtatattttttttattagtgtggatggttttttgatttttgtggtgttttttttagggttttagaagttatgattattattattattattattattttttttggggttattttatttatgttttttttagttagttattttaaggagaaatatagtttaattgaaagatttatgttttgattgtggtggggtggggatttttgggaagaattatttttaagagtaatttttattattttttttatagaaaatatatagtttttataatttttttgttttttgttagttttttagtggttgtttttatatgttttttattttaatggtaggggtggtttatttatttattttttgaaggttattgggaggagtttgatttaattttttagggtggttaggatattttttttatttttttatttttttttttaagataagataattgaggtttggtttgagaatgatttttttttttttattttttagtttgtttttggggagatgagggagttttgtttgtgtttttggatgtgagtagaagagttagtttgttttgttttattatttttggttatatttaggggtttaggaagaatttgtattatttaatgggttgggagttttggttaaggaagaattatatttttggaatagaaatttttatttttttaattttttttttagatagtttattttttttaattaattttttggttagggaggaatgttttttttgtttttttttttgagaagttatttttttgtttgttaatttttttggggttttgtttgtttttttttaatggagggtttttttggggggtggtttttgtttggggggtttttttagttagtattttaggtttttttgttttttttttgttgttattttgatagtataatttatttttaaatggggttttttaataggggagagggagttatttttttttatatttggtggggtgggtgggaaggaagggatttgggggggaatttttttgttgttttttttattttaagtgtttatttttgatattaaatatgaatttttagtttttttttttttagttttttaattttttgtgggtgggtataaaggatttttttaatgtttttggagttgggagggaggaatgggggatataaagtttgttttgtttttattttaggtaagagagagtgggtttaaaagatttttgggtttatttgttagtgttggtttagtttaggttttgggatttgggggttggtgatttgggggatagtgttatatttgtttttattgtttgttttatttttttaaaatggattttttttttttttaaagagttttagagaatggggaattgtttttgtaaatatatattttttaaagtgatgttggaggttgttggtattttttttttgatgttgttaggattagttgagtgtgatatgtatgattgtgtgtggagggtgtgaggtagaggttgattgtgagagaaatggtgtgatggtgtgtgtgagaaataatagtagggattgtatattggtaattatgtgtgtgttagagatgtggaaagttgtgattgtgtgtgagagtgtgtagaagttgtgattatagatttttgatggtgtgtttatgtgggaaattgtggttgtgttttagaaaataattgagtttggatgaatagttaaggtattgtataagaatttgtgatggtatgtataaaataatgtttatgagaagggaatggggattgtagttttgttattgtttgatggtgagtaagatagattgggtgattaaaattatatgtgagagattatgtgggtatgaaattatagtagaggttgttagggattgtggtaaagattgtgtaggtgataaattttattgtaggtgatttaatgtttgagaaatagatgatgtgtaaaattgtttatttgaggttgtagtgttagttaaagttgtaagattgtatgggtgtgaatttgattgtatgggagagaatggttgggagattaaattagtgattgagattaaagatataagaaggtgtaattgtgtgtatgaaagtaggtgtgagagattgtagtaaagattgagaaaaatgaatggttgtgattgggagagtgtgataggttgtgtgtgtgtgtgtgtatatttgaaattagttgtaaattgatttattattattattatagtttattttataggtttagggattgtgagaaagtaggagagaaaat

SEQ ID NO: 434 - DNA, 4406 bp, Artificial Sequence
  chemically treated genomic DNA (Homo sapiens)
ttagtttggattttttatgtttggggaaaaaggttgtatttggagtttgaggtatttattatttgtttattttaggtaagggttgtttatatttaggggttgaggatatttttgatgtagttattttagtttatgggagttggaggttttggttttggttttttagatatggtattgtagggttttgtgttttgtaagtttttaataaatgttggttttatgggtattttaagatagaagagagattggaatttattttttttatatttatgtaggttattttttttagttgttttttgtttttagggtagtggttattattttatagtttggtttgtggtgttgttgtggatggttgtggtatttgtttttatgtttattattggttggggttttattttaggttatatagttattgtatagtagggtgggttgtttaggtggtagagtttgggatttttaagtttttttatggttaagggttttatatttattagttttatgtagatgatgaagggtggttgggtggtttggaagtgtaggatggggatttggggtttgggttttttttgagagtgatagtggttattagttttgtttgagtttggagtttgtttttggagagatgtttttagggtgtatgtagttattaagttggtttatataggagttagggtttgggtagtagataatgtgttagggttatagattgtggtaggtgtttagagtaggaatttggtttttgttatttttgtttgatatttgattgtagaattgattagggtgggttattttaaggtttagatttatgagggatagtggggttttttttttaagaatgggggttgggttttttggaggttttgaggagttagtatggtttaggtggattttgttaagggggaaggtttggagtagttgttttttagttttggagtaggtggttgattttaagggtgatattatgtggttttgtatatttgagagtttttgtggtaatagaagttttttttgattttgtttttgtttatgttatagaatgttattatttggggataagtatagaagggtagttttggataggttggggttagggtttgtgttgtgggatagtatgggggtagggtaggtagtgttggagggtggtaggatgtttattttgtgttggttgttggtagttaagttgtggtatagttggtgtttttgtttgttagtgttttagatggtgaaggttgtttagtggggtagggtttgtttttttaggaagtggatgtggtgggtttagatggttgttttgtggtggagaagagggtgataggtaggttggaggttttatagatgtatatagatgttgatatatagggatatgatgtgtgtttagtttatgttgttagtggagtggatatttggtttaatgtttaagagagattggttgttttatagttaggttatttgttttagttggatgtagttatatgtttaggtggggatttattttttttattagattttaataggtggggatagatgagaagttgttatttaagaatttagaaggttttggaaggtagaatttttgtaggatgtagaggattggatttgatttaagtttagttttttagagaaatttttgtttataaggatatatgtaattattttataaaattttagtgtttatatttggatatgattttttgttttagggttgttgttttgaatttttttatttttttgggaatttggtttttgttttttttttgttgtgataagttgattttaggttgttgttttggggggagtaggtttttttttatgatttgttgttttgtttagtgtttagttttattgttgtttgggttttttttagttttgttttttttttttttattgtagtttttttttatgtgttttattgttgtttgtttgtgtgtgttttttttttaattttgtttttggagttgtttgggttgagtttgttttaaagttttaggagttggatgggttagaagttagaggggtaggggatgtagaggttaatggggttagaatggtgtgggatgtgttttagatgttgttttttttaatggttgtgatgtagttatgttgaagtttggtattttatagattttgttttggttgagttttgggatgttttttgttgtgttaagggagttgtgtttgtgggagttttttttggggtggggtttgggttagatataattaatattggttggtgatgggttttttttgagtagggtttttgtgggtttagttttgggattggggtaggattttgttgttttatgattttgttgttgtttttgttttttgggataaatttgtgatttttttttaattttgtggtattttttgtttgtagtagaatttttataggtaatgggatgggggggatggggggatatggggttttttttgttagtttagggagttgtagggtttaggtattgttagggaggttttgtttggagtttatttttttttttttaattttttgtagttattttaatagtttggattttatttgggatatagggagatgtttattttagttagtgatttggggatattgaagtatgtgtgtgtgtgtgtatattgtgtgggggtgtatggtgtgtgtgtgtgtatattgggggtgtatggtgtgtgtgtgtgtgtatattgggggtgtatggtgtgtgtgtgtatattgtgtgggggtgtatggtgtgtgtgtgtgtatattgtgtgggggtgtatgtgtgtgtgtgtatattgtgggggtgtatggtgtgtgtgtgtgtatattgtgtgggggtgtatggtgtgtgtgtatattgtgggggtgtatggtgtgtgtgtgtgtatattgggggtgtatggtgtgtatgtgtgggggtgtatggtgtgtgtgtatattgtgtgggggtgtatgttgtgtgtgtatagtgtgtatgtgtggtgagtgtatgtgtatatgagtatgtgtatagtgtgtgtaggtgtttggagtatatgtttgtatgtattgtgtggatgtgtgtatatgtatgtgtatatgtgtgtgtagtgagggtttgtgtatgtagtatgagtatatgtatgtagtgagtgtatatgtttgtatgtattgtgtagatgtgtgtatatgtagtgtgtgtgtatgtgagtgtgtgtgtgtagtgagtgtgtgtagtgagtatgtgtgtatatttttgtgtatgtatgtgtgtgtatgttgtatatgtggtttgtgtgtatgtgtagtgtgtgtgtgtgtgtgagaatttgggtgaggatagtttttgtagatggttgtggggatttttttattaggtgatgtagttttgttgggttttggtattttgtttttagtagtttgggtgtgttgggtgttttggggtggggggatgagtttgattttttttatttattgatattagtttagggattttagggggtttatgtgataggaaagtagttagggttttagaagaaagtggggggtttttgtggttgtgggtggtatgtgaggtttggggggtttttgatattggtttttttgatggttttttgttttttgggtttttttaggggtttttggtttgaaaatgttggtttattgtaggaaggtaaaatgtagaagtagttatgatgtttgtatttggtttatttttattttttatattttaaaaagtttttatttaattagggagaataggttttttagggtgttttatgtttttttttttatatttttagaggaagttgtggttttgttttagtattgggaaaggtggaaatttagttttttttaaaagtataagatagtatttttggaaatgttgtaaaggagttgaagtgttagggatatgttattgtatgaggaggtggttaaggtgttggtgggtataagggagaggagtgtggatgtgggaggttttagtatgtaggagtgaggatgatgtttttaatggggaagtttgtggtttttttgttaattttttagttttattttgtgattttggattttagattttttggggagttgggattttgttgagagttttaattttattatggtaggtttgggattattgtggtttttatatttatatatgattttagttggggttttgagattttgggggttttgagtatttgtaggggttgagatgtaagttttggatggtggtttgttttttaatttaatgttgtggtatgtggtaggtaggtggttgagatttttgtgtttttatagttttaaggagggaattgtttgtttggatttaaggaaggaattttatatgtagttttattttgatttgttttatttttgttatggttttaatgtagttatgtggtatttttagatttgggtttatgtggttgttttttatagtgatatg

SEQ ID NO: 435 - DNA, 4406 bp, Artificial Sequence
  chemically treated genomic DNA (Homo sapiens)
tgtgttattgtgaggagtggttatgtgggtttgggtttgggggtgttgtgtggttgtgttggagttgtggtaggggtgaggtaaattggggtgaaattgtatgtagaattttttttttagatttgggtagatagttttttttttagaattgtgaggatatagaggttttggttatttgtttgttgtgtgttgtagtgttaagttggaaagtaggttgttgtttgaggtttgtgttttggtttttatgggtatttagggtttttggagttttaagattttaattagggttatgtgtgggtgtgggagttgtgatggttttaggtttgttgtgatggggttgagatttttggtaagattttagttttttagggggtttaaggtttaaggttatggggtggggttggggggttggtaggagggttatgagtttttttattgggggtattatttttatttttgtatgttggggttttttgtgtttgtgttttttttttttatgtttattggtattttggttgtttttttatgtggtgatgtgtttttgatattttagtttttttgtaatatttttagaaatgttgttttgtgtttttgggaaaaattgggtttttattttttttggtgttaaggtggggttatggttttttttgaggatgtaaaaagagaggtatagggtgttttggggagtttgttttttttgattaaatgagaattttttaaaatgtgaaaaatgaagatgaattaaatatagatattatggttgtttttatattttatttttttatgatgggttaatatttttagattagagatttttaggaaagtttaggagataaggggttgttgaggaggttggtgttagaggttttttaaattttgtgtgttatttatggttatagaggttttttgtttttttttggagttttgattgtttttttgttatgtgaattttttggggtttttaagttgatgttagtggatgaggaggattaggtttgtttttttgttttgagatatttaatatatttgggttgttaaggataagatgttaaaatttggtgaggttgtgttatttggtggggaagtttttgtagttgtttgtaggagttgtttttatttaggtttttatatatatatatatattgtatgtgtatatagattatatgtatagtatgtatatatatatgtgtatgaaagtatatatatgtatttattgtatatgtttattgtatatatgtatttatgtgtatatatattgtatgtatatatatttgtatggtatatgtaggtatgtgtatttattgtatatatgtatttatattgtatgtataggtttttattgtatatatgtgtatatatgtgtgtatatatatttatatagtatatataggtatgtattttgaatatttgtatatattgtatatgtgtttatgtatatatgtatttattatatatgtatattgtgtatatataatatatatttttatatagtgtatatatatattatatatttttatatatatatattatatatttttagtgtatatatatatatattatatatttttatagtatatatatatattatatatttttatatagtatatatatatatatattatatatttttatagtgtatatatatatatatatatttttatatagtatatatatatatatattatatatttttatatagtatatatatatatattatatatttttagtgtatatatatatatatattatatatttttagtgtatatatatatatattatatatttttatatagtatatatatatatatatatgttttagtgtttttaagttattgattgggataagtatttttttgtgttttaggtggggtttggattattgaggtggttgtagagggttggggaggaaaaggtagattttaggtaggatttttttgatagtgtttaagttttgtagttttttgagttgatagaggggattttgtgtttttttattttttttattttattgtttgtgggggttttgttataaatagggggtgttatagggttgggggggagttataagtttattttgggaggtggaggtagtagtagaattgtagaatagtgaaattttgttttgattttgaggttgaatttatgagggttttgtttaggggaggtttgttattagttagtgttggttgtgtttggtttagattttattttggaggagatttttatggatatagtttttttgatatagtagagggtattttaggatttggttagggtagggtttgtggggtattgggttttagtgtggttatattgtggttattggggaggatagtatttgggatatattttatgttgttttggttttgttggtttttgtattttttgtttttttagtttttggtttgtttagtttttggggttttgagatgggtttagtttgggtagttttaggagtagggttgagggagaggtatatataggtagatagtgatggggtatgtggggaggggttgtggtgggaggagagagggtggggttgggaagggtttgggtagtgatggggttgggtgttgggtagagtagtaggttatgggaaggagtttgttttttttgggatagtagtttggggttgatttgttatagtagagggagaatagagattaggtttttaggggagtggaagggtttggggtagtgattttgaggtagaaggttgtgtttaagtgtgaatgttgggattttatgggatggttgtatgtgtttttatggataaaggtttttttgggaaattggatttgggttaagtttagttttttgtgttttatagaaattttgttttttagaattttttagatttttaagtgatagttttttatttgtttttatttgttggggtttaatggaaggggtggatttttatttaggtatgtggttatgtttagttggggtaggtggtttgattgtaggatagttagttttttttaggtattgggttaggtgtttattttattggtaatgtgagttgagtatatattatgtttttgtatgttagtatttgtgtgtatttgtggggtttttggtttgtttattatttttttttttattgtaggatgattatttggatttattgtgtttgttttttggaagagtaggttttgttttgttgggtggtttttattatttggaatgttggtaagtaggggtgttggttgtattgtagtttgattgttggtagttagtgtaaggtgagtattttgttattttttaatattgtttgttttgtttttgtattgttttatagtataggttttggttttggtttgtttagagttgtttttttgtgtttgtttttaggtggtggtattttgtgatgtggatgagaataagattaggaaaggtttttattgttatgaggatttttaggtgtgtagggttgtatggtgttatttttggggttaattatttgttttggggttgagggatagttgttttgagtttttttttttggtagagtttatttgggttgtgttggttttttggggtttttagggagtttagtttttatttttggggggagaattttgttgttttttgtgggtttaggttttggggtagtttattttggttagttttgtagttgggtgttaggtgggggtggtgggagttgggtttttgttttgaatatttgttgtagtttgtgattttggtatgttatttgttgtttaagttttggtttttgtgtgagttaatttggtggttgtgtgtattttgagggtgtttttttggggataagttttaggtttgggtaggattgatggttattgttatttttaggaaagatttaagttttgaatttttattttgtatttttgagttgtttggttattttttgttatttgtgtgaagttggtgagtgtggggtttttggttgtggaagggtttggggattttgggttttgttatttggataatttgttttgttgtgtaatgattgtgtggtttgggatgagattttagttgatggtgggtatggggataggtgttatagttgtttataatagtattatagattaggttgtggggtggtggttgttgttttgggggtaggaggtagttggagagggtggtttgtatgggtgtgggggggatggattttggttttttttttgttttaaaatatttataaagttaatatttgttagaaatttgtaaagtatgaggttttgtggtgttatgtttgaggggttaaggttaggatttttagtttttgtggattgaggtggttgtattggggatgtttttagtttttgagtgtgaatgatttttgtttggggtgggtaggtgatgggtgttttgggttttaaatgtagtttttttttttaagtgtggggagtttaggttgg

SEQ ID NO: 436 - DNA, 4417 bp, Artificial Sequence
  chemically treated genomic DNA (Homo sapiens)
gaaattttgtttttattaaaaatatgaaaagttatttgggtttggtggtgggtgtttgtaggagaatgtagtgaatttgggagtgggaggttgtagtgagtagagattgtgttattgtattttagtttgtatgatagagtgagattttattttaaaaaaaaaaaaaaaagaaagaaagaaagaaaaagaaaagagggtggagatgggggatgatatttagtttaggaggtgtttatggtttggttttttgtggggagaaggaaggttatatgattggtgtggtttagggggtagggttttagtattttaagttgagtttttttttttattttttgaggttggtattggtagtttaggtgggggtttggggatttgaatgggatgaatgggttaagggggatgttattttttttatttttttttatttattgttttttttttttttttttttttttttttttatttttggtttatttattttttattttagttaggagttgttatttaagtagaaaaggggtttttggaaagggggtggggttttgatttttgggtattttgtgtttgaagaggaattttgggaaggggttgtttagggatttggttttttttttatttggttgtataatttttttgtttttttttttttttagttggttgtttttttttgttttgagatgttaggaaagagggggttatttgtgttttttatagtggtttttgaagtttggggtttttagttttagagtttagaggtgaaggaggtgttatagttttggtgattattggttgttttttagttttttttatgttatttttttttaaaataataaaataaataaataaaattgggtttggtgtagtggtttatgtttgtaattttagtattttgggaagttgagatgggtggattataaagttaggagattaagattattttggttaatatggggaaattttgtttttattaaaaaatataataaattagttaggtgttttggtgggtgtttgtagttttagttatttgggaggttgaggtaggagaatggtaggaatttgggaggtggattttgtagtgagttgagattgtgttattgtagtttagttttaataatagagtgagattttgttttaaaaaaaaaaaaaaaattgattggaatattttttaagatgtaagatttttagttttttagagttttataggaaggatggtagagtgtagttgtttagagttgaagttttatttttgttatttgttggttgtgtgattaggtataaattattaatttttttgagtttgtattttattatttgttgttattgagtaatagtagtggattattttttatttttatttttattttatttattttatttttttttgagatggagttttgttttgttatttaggttggagtgtagtggtgtgattttggtttattgtatttatgttttttgggtttaagtgatttttttgttttagttttttgagtagttggaattataggtgtgtattattatatttagttaatttttttttttttttttagtagagatagggttttattatgttggttaggttggttttgaagttttgaatttaggtgatgtatttgttttggttttttaaagtgttgggattgtaggtatgagttattgtgtttggatgaatgtttttaattatattattattattattattattattattattattaatttttgagatggagttttgtttttgttgtttaggttgaagtgtaatggtgggattttggtttattgtaatttttgttttttaggattaagagatttttttgtttaagttttttaagtatttgggagtataggtatgtattattatgtttgatgatattttgtaattttagtagagatggggtttttttatgttggttatgttggtttggaattttttattttagttgatttatttattgtagtttttgataattataggtgtgagttattatgtttagttgtttattttgttttttattagagttttgtattgtgattttgtataaaatagtttggaagttggatttattttgtgtgtgtgattgttttgagtttatagaaagatatttttagagtgtggattgagaagtttttattgtgggaggattggggtgttttagggttttgggagatgggatggatttggaaggttggggggaggggtttttgaggaagaggagttttggaagtgggggttattataggttaaggggtggtttttgggatttttgtagttagtggtgttgtggtggtagagtgtatattgatagttgagagttatggtgtaggagattatggggtttatgttgtgtgggtagttagggagttggatggatttgaagtgtatattgtggtagttgtatattatttgaggtagggttggtaggattttttgtagtatgtgggtttggaagttgtgtgagtgggggaatgagtatgtgtttggggttagtgttttagttgagttttttagttgtttttataggttttagatttaggggtttaggaagttttttgtttttgtttttttatattttattttgtagtttttgattagagaggtagattatttttttttttttgttgtttttgtgggtttggttttgaggtggtagtatttgttttggttttgggtagtttattatggtggggtagtagttggtatagatggtggtgttgatggtgatgtatatggggtagttttttttttttatagttagggtggtattgatggggtggtattgtggttgaagtggttttttggatgtttatgttttgtttatgtttagtagtagtaatagtagtagtttttggggtaaggatattgttttatttgggtttgagattgtagtttttagttttggtttttttattttgtatggtatattatttataaagatttagagattttttttggtattttttatttaggatttattatttggatatttgttttttagagtttattttatagtttagaggatttgagatattttaatattttagatttgtatttttaggaattgatttatttgaagtttattgggggttatgtttttttagaaagaggtttttttttatagtttatatgggtttgtttttttttatgttagtgatggtttggaaggaggtggaaggtgtttaggggttttgtagttttttttggaatatttttatttttggtgtttggaaatgtggatttattttatttttgatatgttttttttttagtgggatattttttgtaagtattgggaatgtggatatggaaagtaaattgagtttttgtgggggagtgagatagggagtgaggggtgttggatgtggtatgggaatttggttagagttagtggatttaattggttgtttttttttagatgtagtttttttttttttttttagggggtgttatggaatgtagggtttttattggttttggggattgggtgatgttagggatgagttttttgtgattggttttattattttgtgtaagattaaagggaagaaaggatgggtttgataattggagttattgtggttttggttgattgagtttgtttttgggtttttaaggttaggtgagggtgtgagggattggagtttgaggttaatttgggttttattggtaggaaaaaaaaaaaaaatttttttattgttttttatataataataaaatataaagggaggatgttttgataggaagaaatgatatttttttaagtgtttttaaattattttaatgtatttttttttttttttttgggatattgagttttgtttggtttttgggggatttttttgtttgttagttatggtggttgttatttgtggtaaatagaatggtgggagtaagtgggatgttttattatttgggttgaggtaggagaattataggaatttaggaggtggaatttttttgtttaggaggggtgtggttttggatttagtttttgtttaatgagagagggtttttttgtgattgtgttgttaggttagttatttgattttggtgttgttaatgagggatttagtttgagttttattttttttttagggatttttgtttattttatttttaagttaggatgtttggagtggtttttggaaatgtgtgtgttttgggtgatttaattgattattgaataggtttgtaggaggtgtgttttgtttttgaggttgtagttttggaggatattatttggatttagttttttttttgtgatgttattaagttggataattttaaggtttgttttttttttaatgtagggtataggatggtatagggaagagggttagaaatttgatttgagttttttgtttagggttgaattttttagtattttgattattttttattgaattttgtttatat

SEQ ID NO: 437 - DNA, 4417 bp, Artificial Sequence
  chemically treated genomic DNA (Homo sapiens)
gtataagtaaggtttaatgagaagtgattaggatgttggagagtttagttttgggtggggagtttaagttaggtttttagtttttttttttgtgttattttatattttatattgggaaagaaatagattttaaaattgtttagtttgatggtattgtggggaagggattaagtttagataatgttttttgaggttgtggttttgggggtaggatatattttttgtgggtttatttaataattagttaaattatttgaagtatatgtatttttggggattgttttgggtattttggtttgagggtagagtgggtagaggtttttaagggagaggtggggtttgggttgaattttttgttggtggtattagggttaagtggttaatttggtagtatagttatggggaggtttttttttattgggtagaaattaagtttgaagttgtgttttttttgggtgaggaggttttattttttaggtttttgtgatttttttgttttagtttgagtagtgggatattttatttgtttttgttattttgtttattataggtgatgattgttatggttgataggtagggaggttttttgaggattgagtaaggtttggtattttaaaaaaaaaaaaaaagatatattgaagtaatttaaaaatatttaggaagatgttatttttttttattaaggtgttttttttttatgttttgttgttatatagggaatgataaaaaaatttttttttttttttttattaatggggtttaggttgattttgaattttagttttttatatttttgtttagttttgagagtttgagggtaggtttaattggttggagttataatggttttggttgttgggtttatttttttttttttttgattttatgtagggtgatggagttaattataagaggtttatttttgatgttatttagtttttagggttagtgagggttttgtgttttgtggtgttttttggagggaggaaggggaattgtatttgagagagagtagttaattgggtttgttgattttggttaggtttttgtgttgtgtttaatattttttattttttgttttatttttttatggagatttaatttattttttatgtttatatttttagtgtttgtggaagatattttgttaagagagagatatgttaaaggtagggtagatttatatttttgggtattaaagatggagatgttttaggaaagattgtagggtttttgggtattttttatttttttttaggttattattggtatgagaaggggtagatttgtgtgagttgtggaaggaggtttttttttggaggagtgtgatttttagtaagttttaggtgggttagtttttgagggtgtggatttgaaatgttggggtattttaggttttttgggttgtggggtgggttttgaaaggtaggtgtttgggtggtgggttttgaatagaagatgttgggaagggtttttgggtttttgtgggtggtgtattatgtgggatgggaaggttaggattgggggttgtagttttagatttgggtgaagtagtgtttttgttttagaggttgttgttgttgttgttgttgagtatgggtgggatatgggtatttaaggagttgttttggttatggtgttgttttattaatgttattttggttgtggagaaggagggttgttttgtgtgtattattgttaatattattatttgtgttggttattgttttattatggtgagttgtttggggttagggtaggtgttgttattttagggttagatttatagaggtagtgggggaggaagggtggtttgtttttttggttaggggttgtggaatggggtgtgggagggtaggaatagagggttttttggatttttgagtttgagatttgtgggggtagttggggagtttagttgaggtgttggttttaggtatatgtttatttttttatttatatggtttttagatttgtgtgttgtagggggttttgttggttttgttttaggtggtgtgtaattattgtgatgtgtgttttgagtttatttggttttttggttgtttgtgtggtgtgaattttgtggttttttatgttgtggtttttagttgttaatgtgtattttgttgttgtagtattattgattgtgggggttttaaggattattttttgatttgtgatgatttttgtttttaggattttttttttttaaaggtttttttttttagttttttaagtttattttgttttttggggttttaggatattttgatttttttataataaaggttttttaatttgtattttggaggtgtttttttgtgggtttagggtaattatatatatagggtgggtttagtttttaaattattttatatagagttatagtatagaattttggtagaaaatagggtggatggttgggtgtggtggtttatgtttgtaattgttggaggttgtggtgggtggattagttgaggtgaggggttttagattaatatgattaatatggagaaattttatttttattaaaattataaaatattgttgggtgtggtggtgtatgtttatatttttaggtatttgggaggtttaggtaggagaattttttgattttaggaggtggaggttgtagtgagttaagattttgttattgtattttagtttgggtaataaaaataaagttttattttaaaaattagtaataataataataataataataataataatataattaaaaatgtttgtttaggtgtagtggtttatgtttgtaattttagtattttgggaggttgaggtaggtgtattatttgagtttaggattttgagattagtttggttaatatggtgaaattttgtttttattaaaaaaaaaaaaaaaaattagttgggtgtggtggtgtgtgtttgtagttttagttatttaggaagttgaggtaggagaattgtttgaatttgggaagtataggtgtagtgagttgagattatgttattgtattttagtttgggtgatagggtgagattttgttttaaaaaaaaataaaataaataaaataaaaataaaaatagaaaatagtttattattattatttaatagtaatagatggtaaaatataggtttagagaaattaatgatttgtgtttggttatatagttaataaatggtagagatgggattttaattttgggtaattgtattttgttattttttttgtagaattttgaggaattgagagttttgtattttggaggatgttttaattaattttttttttttttttgagatggagttttgttttgttgttgagattggattgtagtggtgtgattttggtttattgtaagatttgttttttgggtttttgttatttttttgttttggttttttaagtagttgggattataggtgtttattaggatgtttggttaatttgttgtattttttagtagagatggagtttttttatgttagttaggatagttttgattttttgattttgtgatttgtttgttttggttttttaaagtgttgggattataggtatgaattattgtgttaggtttaattttgtttgtttgttttgttgttttgggaaagggtggtatggagaagattgggaaataattagtggttattagagttgtagtattttttttatttttgagttttggggttgggaattttaggttttggaggttattgtggaggatgtaggtggtttttttttttttgatattttaggatagggaggggtaattggttaggggaagaaaagaataggaaggttatatagttaggtggggaaggggttaaatttttgaataatttttttttagagtttttttttaagtgtagggtatttaagagttaaggttttgttttttttttagaggttttttttttatttaggtgatggtttttggttgggatgggaggtagatggattgggggtgggaggggggggaggaggggaagggagaggtagtggatgaaggagaatggaagagatgatattttttttggtttatttattttatttaggtttttaagtttttatttggattgttagtgttaattttagagggtggaagagggagtttggtttagaatgttgaggttttgttttttgggttatattaattgtgtggttttttttttttttatggaaggttagattatggatattttttgagttggatgttattttttatttttattttttttttttttttttttttttttttttttttttttttttttgagatggagttttgttttgttgtgtaggttggagtgtagtggtgtgatttttgtttattgtaattttttgtttttaggtttattgtatttttttgtaagtgtttgttattaagtttggataattttttgtatttttagtagagatggggtttt

SEQ ID NO: 438 - DNA, 4420 bp, Artificial Sequence
  chemically treated genomic DNA (Homo sapiens)
tttttggtagttttgggggtttttttttgtattttgaaggaaggggaggtgtgtggttggaggtgagaggttttgaggttttgtttggtttttagttttttaaatttgtttttttttgggttgttgtttttagagattgttgaggatatgagttttttatttatgggttgttttaatggagttgggttaggggtttttggatagaggttgtttgtttttttgggttttggggtttgttttttttagtagtttatttgggtttttggggttagggtattgggtagaagttagaggatggtgtgtttgggatttgagttttgggtagtttttggggtttaggatttttggtttttttgtttagttttatgtgttttgtgttttgaaattatgtgtggttttatagttgtgtttttagaagttgttgtggttgttgtgaggtagtagtggatgggatgtttatggttttttttatgttatgttgtttttagttgggttttattatttttttataagttgaaaggaagtggtttttttattagttttggttgggagttttgtgggtgaggttttttttaggagttgtttttttaagtgttttaggtattaataagattttatgtgtgttttttttatagttggttttgtttaggtgttgttgttttagtagaggtgggtggggggtagtgtggagttgtattgtgaggttgtgggtagtttggtgtttgagatttagtggtggtttgaagggtagggttttaatgatatttgtttttagttttgggatggtgtttggttggattgtgtttatatttatgttatttattattagtatgtggttagtattatttttattgatatgtttgtggaggaggatatgggtatttatgagtgttgggttagtaatgatttggattgtaattatttgatttgggtgtttagggttaagtgggtttgtgtttaggtagttgtgttagttttggaatgtgagtggtgggtatttttttttttgttttttttagttttttttttgtgttgtttgttttttggtttttgtttagtagaatttagatgtttttttttttttttgttttgttgtgttttgttgggtttattgtttggatggaggggtttggatttgaagggggtgggtttgttgtttgattattagtgttgggtggtttggtttggggtaggtagggttttgttttttagtaggtgggtttttgttttttttttgatttttgtgttatttgttttgttgtttttgtttttttgggtgtttgtttggttttttttttgagtgtttatattgtaagtttgaggggttttttaagtttagtttaggtttgtaggttttagaattttttgtgttttttgtagtattttgttttaagggatttttaaattttaatttttagtgggaatattgtaaattaattaagaattaagagatttgtttggttggggattggtagaagaattggggtgtttttagtattgttggagtgttgttagtttggggttggggggatgtggggttatttgagtgttttttagagaagggtatgggagttttggttgggggtgttgtggttatttttttttttttttttggagatggagttttgttgtttttaggtggagtgtggtggtataattttggtttattgtaatttttgttttttgggtttaagtgatttttttgttttagttttttgagtagttgggattataggtatgagttaatatgtttagttaattttttgtatttttagaagagatggggttttattgtgttagttaggatggttttgattttttgattttgagatttatttgttttggttttttaaagtgttgggattataggtgtgagtttttgtgtttggttattattgtgtttagttggttatgtttttagaaaagaatttttagtttgtgttggggttgttataagagtttgatgttttggtttttgtttagggatgtgggtgggtgttttgtttgtttttatattttggttttagttttgtgtgtttttgggtaggaatattgttaggtggggtttttgggtttttagtgttttagtttagggtttgttagttgttagtgaagggtgtttttttgaagggggtgtttttttgaaggggtttttttagtaggtgttgggtttttttttttttggaggtgtggttagaagttttttttgggtttttggtttttggggtgtaagggttatggtgtatttttgggatgaaaattagttttttttggggaggagttgtaggtttttgggggttaggtaggtagtgtgggttgtgtttttttattttgttgattgtgttttgttgggttttgtagttggtatagtttttattattgtagaagattttggttttaagatattttttatttgttttttgaatgatagtgttatagaggttatagggtattgttggttgaaggggggtgtggtgttgaaggaggatgtgttgtttggttagaaaatggagtttaagtgagtgtttgattatgttatgttgttatttgtttttttttatggtttttttgttgttagtggtttgtggtttgtgagaataaaagattggttggtaggtttgatttaggtggaagttagggattagttttgtgtagatttttagagggaaattttagggaggggtttgaggggtgtttttgtgaggtagggggttttagtagttttggtaggagtttttattgtttgttttttattaggttttgggtatgaaagggtgttatattgttaggttttgggtatgtgtgtgggttttttaggttttgtgtttttggtataagagggtattatattgaggtatgttttgtttggattttagatgttgttatggttggagttttgttataattggggttgggatggttttgggagtatagagttttttgtttttaggttgattgggaagatggttatagggtgtggggtgtagagtagggattagaggtgtggggtttattagttggggagaagggggtttgttggtttttttatttgtggggttttgttagtttggttttgtttttggggttgtatggggattttaggagtttttttgaggtttagatttgattgggatagttttgtttttttattgtgttgtggttgggtttttggagaattttgggtttttggaggtgttttgtagagttggtatgtggtttatttgtttgttgtggttgtagggtggattttgatgattagtggggagagtatttttgtgtttttttttttgagtttatgggtatggttaatatttagttttatggtgagttttgtagttaggggtattgggtattattgattgttgggagaagttgttggtttgaggtatttggtatattttagagttttggttttttgttttttggaggggaatagtttttttgtgggaggttggggatgggggtgggtttgtggttttaggttttttttttttatttttttgttagggttttttagagtgaaggttgtgaagttgttagaatatattaatgagggggagatggttatgttggtttgtaagttagagtttgtgttatttgttattgattgggtttggtataagattattgattttgaggataaggtgagaagttaaggaggttgggggttttggatttagtttttaggattgggtgagaggtttagattgggggttttggatttagtttttaggattgggtgaggggtttagattgggggttttggatttagtttttaggattgggtgaggggtttagattgggggttttggatttagttttttggattgggtgaggggtttagattgggggttttggatttagttttttggattgggtgaggggtttagattgggggttttggatttagttttttggattgtagttttttagattgggtgaggggtttagattgggggttttggatttagtttttaggattgggtgaggggtttagattgggggttttggatttagttttttggattgggtgaggggtttagattgggggttttggatttagttttttggattgggtgaggggtttagattgggggttttggatttagtttttaggattgggtgaggggtttagattgggggttttggatttagtttttgtttttggttttttaggtttttatgaatggttttgagagtaggttttttgtgagttttttgtagggttggttagagttatatattgagaatttgaatatggaggttgattttggttagtattggtgtaatggtattagttttaagggttttgattaggttattattatgttttgtgtgtgtagttatttggttgttttttggttttttttgggtattgtggttgaggtgttggtgttggttattattatttttatttatg

SEQ ID NO: 439 - DNA, 4420 bp, Artificial Sequence
  chemically treated genomic DNA (Homo sapiens)
tgtagatgaagatgatggtgattagtattagtattttagttatgatgtttaggaagggttagagggtggttaggtggttgtgtatgtggagtgtgatgatggtttggttggagtttttggagttggtgttgttgtattggtattggttggggttggtttttatgtttaggtttttaatgtgtagttttgattggttttgtgaggaatttatgaagaatttgtttttggagttgtttatgagggtttaggggattaaaggtaagggttgagtttaggatttttagtttaggttttttatttagttttgagggttgagtttgggatttttagtttaggttttttatttagtttggagggttgagtttgggatttttagtttaggttttttatttagtttggagggttgggtttgggatttttagtttaggttttttatttagttttgagggttgggtttgggatttttagtttaggttttttatttagtttggagggttgtagtttagagggttgggtttgggatttttagtttaggttttttatttagtttggagggttgggtttgggatttttagtttaggttttttatttagtttggagggttgggtttgggatttttagtttaggttttttatttagttttgagggttgggtttgggatttttagtttaggttttttatttagttttgagggttgggtttgggatttttagtttaggttttttatttagttttgagggttgggtttaggatttttagtttttttggttttttattttgtttttagagttagtgattttgtattaggtttagttagtgataggtggtatggattttgatttgtagattagtatggttgttttttttttgttgatgtgttttgatgattttatagtttttattttgggaggttttgataggagggtgagagagaggagtttggaattgtaggtttgtttttatttttggttttttgtaggagggttgtttttttttagggagtagggggttagggttttgggatgtgttgggtgttttaggttaataattttttttgatagttggtggtgtttggtatttttggttgtaggatttattgtggagttggatgttggttgtgtttatgggtttggggaggaagatgtaggagtattttttttattggttgttggagtttattttgtaattatagtaggtaggtgagttgtgtattagttttgtaggatgtttttaaggatttagggttttttaggggtttaattatggtatagtgaaaaagtaaaattgttttagttaagtttgaattttaaaagaatttttggggtttttgtgtggttttaaggatagagttaggttggtaagattttataggtgagagaattaatagatttttttttttttgattgatgaattttatatttttggtttttgttttgtattttatattttgtgattgtttttttagttagtttgaaaataaaaggttttgtgtttttagggttgttttagttttagttatgataaagttttggttatgatagtgtttggggtttgagtagggtatgttttagtgtggtgtttttttgtgttaggagtatagagtttgggaggtttgtatatgtgtttgggatttggtagtgtggtgtttttttgtgtttgggatttagtgaggagtaagtaatggggatttttgttagggttgttggagttttttgttttataaggatgttttttagatttttttttggggtttttttttgggggtttgtgtggagttggtttttaatttttgtttggattaagtttgttgattggttttttgtttttatggattataggttgttggtggtaagagagttgtgagaaggggtaggtggtggtatggtgtggttaggtatttatttgaattttgttttttggttgggtagtgtgtttttttttagtattatgtttttttttagttagtggtgttttgtgatttttgtggtgttgttatttaaggagtaggtgaggagtattttggagttaaggttttttatggtagtgaagattgtgttggttgtaaggtttggtgagatgtggttagtagagtggaggagtatggtttgtgttgtttgtttgatttttaggaatttgtggtttttttttgggaaggattggtttttattttaaaaatatattgtggtttttatgttttgaggattggaggtttaaggggaatttttggttatgtttttgggaagggaagagtttagtgtttgttgaggaggtttttttgggaaggtattttttttgggaaggtattttttgttggtagttggtgggttttgggttaaggtgttgggaatttagaggttttgtttggtgatgtttttgtttagagatatatgaggttgggattagggtgtggggatagataaggtatttatttatgtttttgagtagggattagggtattgagtttttgtagtagttttagtataaattggaaatttttttttaaaaatgtagttagttgggtgtggtggtggttgggtgtggaggtttatgtttgtaattttagtattttgggaggttaaggtgggtggattttgaggttgggagattgagattattttggttaatatggtgaaattttgttttttttaaaaatataaaaaattagttgggtatgttggtttatgtttgtaattttagttatttaggaggttgaggtagaagaattgtttgaatttgggaggtggaagttgtagtgagttgagattgtgttattatattttatttgggaatagtaagattttatttttaggaaaaaaaaaaaaaatagttatagtatttttggttaaggtttttgtgtttttttttaggaggtatttaggtggttttatatttttttagttttaggttgatggtattttagtagtgttgggagtattttggtttttttgttaatttttaattaagtaaattttttggtttttggttagtttataatatttttgttaggaattgaaatttgaaaattttttagaatgagatgttgtgaaggatatagaaggttttgagatttgtaagtttgggttgagtttggagggttttttaggtttgtagtatggatgtttagggagggagttgggtaggtgtttggggaagtagaaatgatggaatggatggtatgagggttgaggggaggatgaggatttatttgttggagggtagagttttgtttgttttgagttaggttgtttagtgttggtggttaggtggtgagtttattttttttaggtttgggtttttttgtttaggtggtgggtttaatggggtatagtgggatggagaggggaggaggtgtttgggttttattgagtaggagttgggaggtgagtggtataggagggaaattgagggaggtggggagggaggtgtttgttatttatgttttaggattagtatgattgtttgggtgtggatttatttgattttgggtgtttgggttaggtggttgtgatttgggttgttgttggtttggtatttgtaagtgtttgtgtttttttttatgagtgtgttgatggagatggtgttggttgtgtgttggtggtaggtggtgtggatgtggatgtggtttagttgggtgttgttttagagttgggagtaggtgttgttgggattttgttttttaaattattattggattttgggtattgggttgtttatggttttgtagtgtagttttatattgttttttatttatttttgttgggatagtggtgtttggatgaagttggttgtggggagagtatgtgtggggttttgttagtgtttggggtatttgggagggtagtttttggggaaggttttgtttataggatttttagttagggttggtggagaagttatttttttttagtttgtgggagagtgatggggtttggttggaaatagtatggtatgggaaagattgtgggtgttttgtttattgttattttatggtagttatggtggtttttgagggtataattgtgggattatatgtggttttaaaatataaaatatatgaaattgggtagaagagttaggagttttgagttttgagggttgtttagagtttaggttttaagtgtattgttttttgatttttgtttgatattttgattttagagatttgggtgagttgttgagaaaaataaattttaaagtttaaaggggtaggtggtttttgtttagaagtttttagtttggttttgttaggatagtttgtgggtggaaagtttgtgtttttagtaatttttgagggtggtgatttagagagaggtggatttgggaagttgggagttaggtagggttttagggttttttatttttagttatatgttttttttttttttgaaatgtaagggaaggtttttagagttgttaagga

SEQ ID NO: 440 - DNA, 4258 bp, Artificial Sequence
  chemically treated genomic DNA (Homo sapiens)
tttttaaagtgttgggattataggtttgagttattgtgtttggtttaaagtaattgtttttttattggtttttttgtttttggttttattaaatgttttattttaaattattgtagataaggggttttgtttaaggaggagagtttattagttaaaattttttagtagtttttaattattttaggataaatgtagatttattttttgttttttgttgttgttttttttttttttagattttatatggttttagttatatttttagattatttgggttgttgtttgttttgttatatattttttttattttgtttttttgtaagttttatttaggttgtatttatatagttgttttagtttttatttgaggtttttgtagttttttttgaaagtttttattatagttaatgatattgaaattgtttttttatgtagggtatggaaagatttatttaatttattgtttaatttttttttttggtgtagaaaagatatttagttagtgatttgtattatttgtaggtatgagtgaataataataatgtttaatttttatatagtgttaattttatgtttggtattgttttaggtatttatataaatttatgtaatttatataattttaaaattgatgatatttttttattttattaagtattgagtagttaaataatttgttttagatattaaggggttgagttggggtttgaagtttggttatttataaatgaattaagaattggaaggaggataagagttttgagaaggagttaggtagggtgtgatttgtgtgttttatatttaagattttttagtttttagggagtttgttttatagagtaggagatagaggttgggagggatatggagagttttgagagttgtgtggaggaagtggtgttgtttggggtttgggagtaagggtgtggtttggatgtgtgggtgtttgggatggtatgtttttagattaaattataatttttaggatttagtgggtgttgttgtttatgtgatgttatggtggtggagggtgtaggtggttgggtgtttggtgagtggattgtttgagtttttttgttgggatttgggttttggttttggttttgtggtaagtggggtgattttagtttatttagtttgtggaggttttgtggtgtatgtttgtagtttttattatagtgtgggtgtgtagatggggttggtatttattatatggggggtatttgggttgaattaagtgatttgtgtggggggttttgttggggattttgtgttgtatttttttaagttggttttaggggtttagggttggtgttgtatgtttgttggttgtgtttttagggtttgggtttgaaggtgttgggtaggtaggggtagttttgttttttgagaagggtatttgggattttggggtgttggggtgaggtttttgggttggaagggtttgaggggttttttttttgatagtttttttattgttagtagagttttgggttggggaatagaagtttttgggaggttaggttttttgggtgtggtttgtgtgtatttggggagatggtgggagtggtggggagaggttgtttgggtttggggagattgatgtataggtggagagatggtgtgggttttgtggatttggatttttataatttttttttttttgttttggtagatgggagttgttttttgtgggttgagtttgttagtatttttgatgtattttggtttttgaagttggagaagagtttttatttatttatatttttttgttttattttgggttgtttgggtttttagttttagtggatttttagttttagtggttattgggtttgaaaggagtaagatgatgattttggtgttggtgttgaggagtggttttgggggtgggtttttgttttggttttttttgggatttgtatttgtgttttgggtttgtttgatgttggttattgatatatattatgtggagatggtttgggagtgttttaagattgttatttttttttataattagttggttattgatgtggtagtggagaaggtgtgtaagggggtagttagtttagggtttgggatgtaggtgggagggagagtgttgggggttttttgtttaaggtttttttttttttttagtttttagtttgtttaatgtttattatgatgttttatgttggttgtttttaggatggtagttattttttggtaagatttatgttttttattttttttgtggattttggagtttttttagatatttaggttttagttttgttttttttttttatttttttttagaaaagtgtttggtatttgtagtaagaatttttagtgaggattgtttattgtattaagggtttttgttgttttttttttattattggttgtaattttattatattgtatgtggtaaggtagagaggattttaggttagtgggttattttgttttgggggtaagtggggagtttggggtttagagtggtagatgattgtttgtttaaaggtgttagggttatataggatttaattttaggtttttagaagttaaaggtgtgtatttatggagtttggaagggttgaagtgggggtttgattatgtggttgattagttgggtggtgatttttatgggtaggtgggggtggttgttttttgtttagtgtttatgtggttttgtgaatttttatattttttttttgtagtatgagttatatatttgtgttttttagaagttgatagatttttttttggtgagtgttgggttagagtagggtgaggggttgagaggttgggtttggattatttttttttatgattttgtgatttgtagattaaggattaggtggatgaggtttagtattgttagttggtgtgatagttgttggatgattataaggatgtggtgatttttttggtagagggtttatgtgagagttggaagtatatagaggttggggtagtaaaggagaggttgggtttgttgggggtgggaagggtatgggattttgagattttattttttataggatgaaaagtttgtttgttattttttggataagatgttgattttgaggtttggaatttgtatgttggttatgtattatttggtgttgtatgaggataaggtggggttttgggatttgagatttatttgggaatattaagtgagatagaggagattgggttggggatttgggttaagggtttgggggttgaggttgtggggttggtgttttggggtagttttgaagttgttagtattttggggtggggttaggggtgtgggtagttttgattttttttttttggttagtttgattttgttggtattatttgtatttgttttttattaaagaagattattgagaagtgggtggattttgttaggtgaggtaagaatggtttagggggtgggtagatatttggggtagggaaggtttgggtttgagtttttgtttggggtatgatttgtggggagtagggttttttaattatggtattattgatatttttagttagataattttttgttataggggttgttttgtgtatgttaggaagtttagtagtatttttggtgttagtagtattgtttagttgtgataaataaaaatgtttttgtatattgttatatgttatttaggggggtagaattgtttttagttgtaaattattggtggaggggtttttgattgaatttttgtttttatttgtagatgtttgtgtgagtataagtatggtaatgtgttttgtgtttgtattaatggttatgtggttgtttggtttttttttatttttatgttattggattatattttgttggagttgtttaagaatgttatgaggtggggtggtttgatgtgttggtttgggggtggataggaattggggtgtttgtatttattggttttttttttttgtatagagttataatggagagttatttagatattttttataatgttttagatgtggttattattattgttaataatgatgttgatttgattattaggtttgttttgagtgggagttgagttgaggtggatgggatgggggtttaggtattgtttttgatttgatttaggattttgagtttttttttgttttattttgggatttggtttttgattagataaattattttttgaattttgagatggttatgagttgtttattaatggatttggggttagttgtaggtttaggtattttgtttttgttagtagttgaggagtttgaaattgagaaatag

SEQ ID NO: 441 - DNA, 4258 bp, Artificial Sequence
  chemically treated genomic DNA (Homo sapiens)
ttattttttaattttaagttttttagttgttgatagaggtaggatatttaggtttgtagttggttttagatttattaataagtagtttatggttattttaggatttagagaatagtttgtttggttagggattaagttttagaatggggtaggaaggggtttaaggttttaaattaagttagaaatagtgtttagatttttattttatttattttagtttaatttttatttagggtaaatttgatgattagattgatattattgttggtgatggtgatgattatatttgggatattgtagggagtgtttaggtgattttttattgtggttttatgtagaggggaaagattagtaggtataagtattttggtttttgtttgtttttaagttagtatattaagttattttattttatggtatttttgagtagttttggtaggatgtagtttagtggtatagggatgaaggggaattgggtagttatatggttattgatgtggatatggggtgtattgttatatttgtgtttatataggtgtttgtggataggagtgagggtttagttaggggtttttttattagtggtttgtaattggaaataattttgtttttttaagtaatatatggtaatgtgtagagatatttttgtttgttataattaggtagtattgttggtgttagggatgttgttgaattttttaatgtgtatggggtagtttttgtgataaagaattatttggttggaaatgttaatagtgttatggttgagaaattttgttttttgtagattatgttttgggtaagggtttagatttaagttttttttgttttagatgtttgtttattttttgagttatttttgttttatttggtaaagtttatttattttttaataattttttttggtgagagatgagtatagatgatgttgataaagttaggttggttggagaaaggaggttaggattatttatgtttttagttttattttaagatgttggtaattttggaattgttttaaagtattagttttatagttttagtttttaggtttttgatttggatttttagtttagttttttttgttttatttaatgtttttaggtgggttttaggttttagagttttattttgtttttatgtagtgttaggtgatgtgtggttaatatgtggattttaagttttgaagttagtgttttgtttaagaagtagtggatgagttttttattttgtaaagagtgaggttttagaattttgtgttttttttatttttagtaggtttggttttttttttgttgttttaatttttatgtgtttttggtttttatgtaggttttttgttaagagggttattatatttttgtggttatttagtagttgttgtattagttggtagtattgggttttgtttgtttggtttttgatttgtaggttatagagttatgaggaagggtggtttaagtttaattttttagttttttattttgttttggtttagtatttattggagggaagtttgttagtttttggaaggtatggatatatagtttatgttgtaaggaagaggtgtgggaatttataaagttgtatgggtattgagtagagaatagttatttttatttatttatggggattattatttagttggttgattatgtgattaaatttttattttgatttttttaggttttgtgaatatatatttttggtttttgaaggtttggggttgaattttgtgtggttttgatatttttaggtaagtaattgtttgttattttgggttttagattttttatttgtttttggggtagggtggtttgttgatttaaggttttttttattttattatgtgtagtatggtggggttgtagttaatgatgaaaggaaggtagtggaagtttttgatgtggtgagtaatttttattggaagtttttgttgtaggtattgagtatttttttgggagaaaatgagaagggaaggtggggttggagtttgagtgtttgggagagttttaggatttatgaggaaaatagagggtgtgaattttattagaaggtggttgttgttttgagagtggttagtgtagagtattatggtgggtgttaggtggattgagggttagagagggagagaggttttgagtagagaatttttaatatttttttttttgtttatattttggattttgggttggttgtttttttgtgtattttttttgttgttgtgttgatggttgattggttgtaaaaggaggtgatggttttggagtgtttttgagttatttttatgtggtgtgtgttggtggttgatgttgagtgggtttggagtgtgagtgtgggttttaggaggggttggagtggaagtttgtttttgggattgttttttagtattgatgttaggattattgttttgttttttttagatttggtggttgttaggattgaggatttgttaggattgaggatttaggtgatttaaaatggggtaagggggtgtgggtgggtaggggtttttttttgattttagggattagggtgtgttgaggatgttgataggtttagtttgtggagagtagtttttatttattggggtggggaagaggaagttgtaaggatttgaatttatagaatttgtattatttttttatttgtgtattggtttttttagatttgggtgatttttttttattatttttattgtttttttagatgtatataggttgtgtttaaaggatttagttttttgggggtttttattttttaatttgaggttttattggtggtgggagggttgttgggggaggagttttttagatttttttagtttgaaaattttgttttagtgttttggggttttgggtattttttttagggggtggggttgtttttgtttgtttagtgtttttaaatttgggttttgggagtgtggttagtgaatgtgtgatattagttttgggtttttggggttggtttgggagggtgtggtatggagtttttagtgggattttttatgtgggttatttggtttggtttggatgttttttatatggtagatgttagttttgtttgtgtgtttgtgttgtgatggaggttgtggatgtgtgttgtggggtttttgtggattgagtaggttggggttgttttatttattgtggggttggagttagggtttgggttttagtggaagggtttgaatagtttatttgttaggtgtttagttgtttgtgttttttgttgttgtgatgttgtgtgggtggtagtgtttgttgggttttgggagttgtagtttggtttgaggatgtgttgttttgggtgtttgtgtatttaggttatgtttttgtttttggattttaaatagtattgttttttttatatggtttttgaggttttttgtgttttttttagtttttattttttgttttatgaaatgggttttttgggagttggaagattttagatgtaaagtgtatagattatgttttatttgatttttttttggagtttttgttttttttttagtttttggtttatttatgggtaattaggttttaaattttagtttgattttttaatatttggagtaagttatttaattgtttagtgtttggtaagatgaagagatattattagttttggggttgtgtggattatatgaatttatatgagtgtttagaatagtgttaggtgtggaattagtattatataagggttaggtattattattatttatttatgtttgtagataatgtaagttgttgattgggtgttttttttgtattaggagaggagattgggtagtgagttgaatagatttttttgtgttttgtataagaaaatagttttagtattattggttgtgatgaggatttttagaggaggttgtgggagttttagatagaaattgagatagttgtgtaggtgtagtttgagtaggatttgtaagggagtggggtgggaagggtgtgtggtaggatagataatagtttagatggtttgaggatatggttggagttatatgggatttgggaaggagaggggtggtagtagagagtgaaggataagtttgtatttgttttagggtagttaggaattattgaagggttttaattggtgggtttttttttttagatagaattttttgtttgtagtgatttagagtggggtgtttggtgagattaaaggtagagaaattaataagaagataattattttaggttaggtgtagtggtttaggtttgtaattttagtattttgagag

SEQ ID NO: 442 - DNA, 4435 bp, Artificial Sequence
  chemically treated genomic DNA (Homo sapiens)
tgtaggtgtttagggtttataggtttggagtggtttttgtttttgttggattatttagggttgttttgttggaggggtttttttgtttttgagttttaggttatgtttggaaggtttggggtttttgtgtttggttatgttatttgtttggtggttttagggatttagtgttggggttagtgtaggttttgtttagtgtttttgttttttttagttggttggtttttgggattgtgtttttgtttgtgttttttatgtttgtatttgtatgggtagggtggtttggggttttttagttttgagttgtggttttttgaagtgtgttatttggatgtgtgttgtttgtagattttggatgagttgggtttgggtgttgtgtggtggaattgattttgttttggattgtaggtagtagttgattttgtgttattggtttgtgggtgagattttaggtgtgagatgggttgtgtgtgtgtgtgtgtgtgtgagagagagagagagagagagagagagagagagagagagagagagtgtgtgtgtgtgtgtgtgtgtgtgtgtgtgtgtgtgtgtgtgttgggggaggggtttgaggatttgttttttagttgagtgttaggatggggggtggatttttaggagttgtgtggtgtttgtagaggagaggaagtgttggagatttttttgtttttatttggtttttttgttttgtttttttttttggggttttagagaggggagttttaggtgtggggtgtttggtttatgtggtgtggtgttgggtggggtaggtgggggtgtggtgagagttgtggagttttttttatgggtgggggggtgggggtggttgggttttgtttttgggggattggggtgtgttttgttaatgggtagttgggtgtggggtggggttgtggggttgttgtttaaagaaatttgttgtgggttttgtagtgggatttgagttttggtggtggtggtggtggtggtaggggtgagggttggggttattgtgtggtgattttgggttttggagtgattgtagggtagttttgggtgttggttttggtgtgtgttttttgtgtgtgtttttttgtgtgtggttttgatgttggatatgagtgaggtttgtttttagttgttttgtagtttgtttggtattgttagttttatgttgtatgtggaggatttggatttggatgtgttgttgttttttgttggttttgagggtttgggttgtgtgggggttgtggtggggggtgtttggggtgatttggtggaggtggtggatgagtgttttttggtttgtatttgtgatgttgtgttgtaggtgtttaagggttatgattggagtttggtgtttatgttggtgtgtggtggtggtggtggtgtgtttaaagttaagttgtatgtgaagtggtttatgaatgtatttatggtgtgggtgtaggtggtgtgttgtaagttggttgattagtatttgtatttgtataatgttgagtttagtaagatgttgggtaagttgtggtggtgagtgttggtgttttgggggtggggtttgggattttggttgtttttggttttggattgtgagtgggggtttggagggtgtagagtttgtggaggtggtggttatatgtaggttttgggttttgtattttgggtgggtgttagggtgggttttagtggaaaaatattttttggttagttggggtttggtgttagttatgggagttgggatttgtggagggtagtgtttggggtgtgtatttttgtggtgggtgtgttttggagttagtttttttggtggggaatattttgtggagggttatggttggtattttgatgtgttttttagttgttgtgagtggttttagttttgggaggtatgtttggtatgatagtaagttgtatgtggttttttggaggtgttttttttttagaaagggtttagtttttttagtttttggattatttatggggagggagtgtggtaggtggatgggtgggtagtaggtttgtttgtgagtattttttttgtagttttttttttttttggatatttttggtttgaagtagggagggtaggagtggagatgatggggtgtgttgtgtgtatgttttggtgtggtggggttggttagttttttagaaattaggattgtagagtgaagaatttgttgtttaggataggttgtttttattgagtgttttttggttgggttttaaatggtttttttggtttggggttttggtttttgtattttgttttttatttggaagaagggagtttggagtttgtgtatttgtattttttgttttttgtttggatttagggtgtagttatggggtgttgtggatggtaggtttttgtttttttaagttttgttgtataggtggttggaggtgagttttgggaagagttttaaggagtgtgttttgtggtttagtgaggatgggtgtttgggttttgttagggtttttgggtgtttgggaatggagggatagtagtttagttgtttgttgaaggttggtattgtttttgggaagttttgtttttgtttattgttggttgggttttgtttgttttttttgttttttttagaaagttttagagggagggaatagtaggtttggaatagggggaaatagaaggaggaagatgggaggtgtggggtttgtttttttttggttgttgtaagtatattaatttttttaaataggtgttggttggtttttttagaggagtgtattgtttggtgttatgggaggttttggagtgtatggtaggtgggtttttttggttagagttttttggttttggtttttgttgttggttttttttgtggtgtgtgtttgtgttgagggtatagtgggtgttttggttatttttgtttttgttttgtgttgtagtttgttgagtgagagtgagaagtggttttttgtggaggaggtagagtgtttttgtgtgtagtataagaaggattattttgattataagtattagttatggtgtaggaagagtgttaaagttggttatagtgattttgatttgggtgtggagttgggattttattttggtggtggtgttgtgtataaggttgaagtagggtttggagatgggtattattatggtgattatataggtgggttttaggttttttgtatatttgagggtttttgtatgggaggtagttgtggggtttttggttgagaagggtgtatgatggtggaggggggtaggtgtttttgagagaattgggttttttttgggttttttgaaaaagtttttaaggttttggttgtttttgtttttggtgtatgagggatttgtttagttattttgagtgttgaggggttgatagttttgtttggtagggattttgagaggtggtgtttttagtaagatttagtttaatgtgggtttttttttttatattgagttgttgtttatatggtatttagtagttttagttttagggttagattgatagggtggagttttgttggggttttggttaggttggttgatgtttgttagttttagagtgtttggttggtttggggaggaatagggtttgtgtggttttttagtgttttgtaaattttagttttggttaggttgggtttgttggttttttttttttattttggtttttgggaggggttttgggtttttttatagtatagtgttttatggaatttttttggttgaggagtgaggtttaggtttgattttgttggaatttttgggaaatgtaaagaaataaaaagttgttgatttttttggtagttagtgtgggtgtttttttttttttagtttggttggttttatttgttttatagaaggggtatttatttttgaagtttgtttttttgtttttagggtagatttatgggttgtttattttgtttattatttttaagatggagttgtagtaggtgggtgttaagttggagttgaagttggagggatgttggttggtggatagtgggtgttagaatattgattttagtaatgtggatattttggagtttagtagtgaggttatgggtattatggatgtttttgatgtttatgagtttgattagtatttgtttttgggtggttttgttttatttgagttgggttaggtttatgggggtgtttatttttatgttggggtgttttttgtgtgggtttataagagtgttttgttggtttttgtgttgtttattgagatgggttttttatggttgtatattaagatggagtagttgagttttggttattatggtgattagttttgaggtttgtttgattatggtttttgtagtggttagtttagtgttattttggttgtttttgttggtttttttgttggtttatagggtgattatggtgatttgtaggtttttagttattatggtgtttattttggttatgtatttggttttt

SEQ ID NO: 443 - DNA, 4435 bp, Artificial Sequence
  chemically treated genomic DNA (Homo sapiens)
agaggttgggtgtgtagttagggtaggtattatagtagttggaggtttgtaggttgttatagttgttttgtgagttggtgaaggggttggtgggggtggttggggtggtgttggattggttgttgtaggaattgtagttgggtgagttttggggttggttgttgtagtggttggggtttggttgttttgttttgatgtgtggttgtgggggatttgttttggtgggtgatgtggaggttgatggggtatttttgtgggtttatatgggggatgttttggtgtggaagtaggtgtttttataggtttggtttggtttgggtggggtggggttgtttaggggtaggtattggttgaatttgtggatgttgaaggtgtttatggtgtttatgattttgttgttgagttttgagatgtttatattgttgaagttgatgttttggtgtttgttgtttattggttggtgtttttttagttttagttttggtttggtgtttgtttgttgtagttttgttttgggggtggtgggtggggtgggtggtttgtgggtttgttttggggataggagagtaggttttagggatgaatgttttttttgtggggtgggtggggttggttaggttggaaggggagggatgtttgtgttaattgttagggggattaatggttttttgtttttttatattttttagaaattttagtaaagttagatttagattttattttttggttgagaaaattttatgaagtgttgtgttatgagaagatttgaggttttttttagagattaaggtggggggaagaagttgataggtttagtttggttagagttggggtttatagggtgttgggggattatatagattttgtttttttttgggttagttaagtattttgaggttggtgggtgttagttagtttgattgaggttttggtaggattttattttgttagtttggttttgaagttggggttgttgagtgttgtgtgggtagtagtttggtgtgggaagaggagtttgtattggattgagttttgttgaaaatattattttttggggtttttgttaagtaaagttgttagttttttagtatttaaggtggttaagtaggttttttgtgtattaaaaataggggtggttggggttttgggagtttttttagggaatttggggaaggtttggtttttttgagggtgtttgtttttttttattattatgtattttttttagttagaaattttatagttgttttttatatagggatttttagatatgtggggggtttggagtttatttgtgtggttgttatggtggtgtttatttttaagttttgttttagttttgtatatggtattgttgttagggtggggttttagttttgtgtttgagttggagttgttgtggttggttttggtgttttttttgtgttgtggttggtatttgtagttggggtggttttttttgtgttgtatgtgaaggtgttttgttttttttatgaagggttgttttttgtttttgtttagtaagttgtagtatagggtagaggtagggatggttagggtgtttattgtgtttttggtgtaggtatatattatagggggaattggtagtagaggttggggttaggaggttttgattagggaaatttgtttgttgtgtgttttggagttttttgtggtattaggtagtatatttttttgggagaattggttggtgtttgtttgggaaggttggtatgtttatgatagttaaagaagaataagttttatgttttttatttttttttttttatttttttttattttgggtttgttgttttttttttttggggttttttaagggaggtgggggaggtgggtaggatttagttggtggtggataaaagtgaggttttttgggaatggtgttggtttttggtgggtagttgggttgttgtttttttatttttagatatttagaagttttggtagggtttaggtgtttgtttttattgagttataggatatattttttgggattttttttgaggtttatttttaattgtttgtgtggtaggatttgggggagtaggggtttgttgtttatagtgttttgtggttgtgttttagatttagatagaaggtaggaggtgtaaatatgtaagttttaagttttttttttttaggtgaggagtaggatatgggaattagagttttaaattaagagaattatttgaaatttaattagaggatatttggtgggggtggtttgttttgagtaataagttttttattttgtagttttaatttttggaaaattgattggttttattatgttaaggtgtgtatatggtgtattttgttatttttatttttgttttttttgttttggattgagggtgtttaggagagggagaaattgtggggagggtatttgtaggtaaatttgttgtttatttatttgtttgttgtattttttttttatgggtggtttaggagttagaggagttgagttttttttaaggagggagtatttttagagagttgtatgtaatttgttgttgtgttgggtgtgttttttggggttggggttatttgtaatggttggagggtatgttggggtgttagttatggttttttgtagggtgttttttgttaggagaattggttttagagtgtatttgttatgagggtgtatattttaggtgttgttttttgtggattttgatttttatagttggtgttggattttggttggttagaggatgtttttttattgggatttgttttgatatttgtttggggtgtagagtttggagtttgtgtgtggttattatttttgtgagttttgtgttttttaggtttttgtttgtagtttgagattaggggtggttaaggttttgaattttgtttttggggtgttggtatttattgttatagtttgtttagtgttttgttgagtttggtgttgtgtaggtgtgggtattggttggttagtttgtggtgtgttgtttgtgtttatattatgaatgtgtttatgggttgttttatatgtggtttggttttgagtgtgttgttgttgttgttgtgtattggtatgggtattagattttagttgtagtttttgagtatttgtgatatggtgttgtggatgtaggttgggaagtgtttgtttgttgtttttgttgggttgttttgggtgttttttattgtgatttttgtgtggtttaggtttttggagttggtgggagatggtggtgtgtttgagtttgagttttttatgtgtgatatggagttggtggtgttggatgggttgtagggtggttgggagtgggttttgtttatgtttagtattggggttgtgtgtggaggggtgtgtataggagatgtgtattggggttggtgtttggggttgttttgtggttgttttgggatttgaggttgttgtgtggtggttttgatttttgtttttgttgttgttgttgttgttgttgaggtttgggttttgttgtgggatttgtaataagtttttttaagtggtggttttgtggttttgttttgtgtttggttatttattggtggagtgtgttttgattttttggaggtggagtttggttgtttttgtttttttatttataaagaaagttttgtggtttttgttgtgtttttgtttgttttgtttggtgttgtattatgtgggttaggtgttttatgtttggagtttttttttttggagttttgggaaaggaagtggggtagggaggttgggtgggagtaggggggtttttggtgtttttttttttttgtgggtgttgtgtggtttttgagagtttgttttttgttttgatgtttagttaggaagtgggtttttgggttttttttttgatatatatatatatatatatatatatatatatatatatatatatttttttttttttttttttttttttttttttttttttttttttttatatatatatatatatatatagtttgttttgtgtttgaggttttgtttgtaggttggtggtgtggggttagttgttgtttgtggtttaggatagggttggttttgttgtgtagtgtttaggtttagtttgtttagagtttgtggatagtgtatgtttaggtaatgtgttttaaggggttgtggtttggagttgggggattttgggttgttttgtttatatgagtgtgagtgtggagagtgtgggtgggggtgtggttttgggggttggttagttggagggggtgggagtgttgggtggggtttgtgttgattttggtgttgagtttttggggttgttgggtggatggtgtggttggatgtgggggttttgggttttttgggtgtgatttagggtttgggggtggggaggtttttttggtggggtggttttgggtggtttggtagaggtggaggttgttttgagtttgtgagttttgggtgtttgtg

SEQ ID NO: 444 - DNA, 4784 bp, Artificial Sequence
  chemically treated genomic DNA (Homo sapiens)
tttggttgtattgggatttatagagttatattttggagggttttttttttgatattgataagggtgtgtattatattttagtgagtgttatatggttgggggttaatgggagttatattttttagatttttagtgtgttttttattgaggtttattttgaagattatagtgagttgtagttggtgaggatagtttttttagattttggtgaggtggtattatttgtttgtgttgtggatgaatttgtgattgttttgatggtgattttggatgttgattttattaagatgattttaaagtaaaggattgattttttgtataggatgtggagttttttagaagtagagttttataatatgaaattagtgttggtggtgaataatagattatttgatatgttggtttttatggttggtttgggaaatgtaaaaaaggtggtggagaatggggttttttttttttggaagttgggttgttttttgaattagaatagtgtgtttgatatttatggtgtagaggtttttgttagggagggtgtaatgtttgtttagtttggttattttgtggtgggttggtatattgttaataagaagttttttttttttaaatgtgtttggaggtagatttatgttatatttatatttgttattgttattgggtttttaattatggttatttaggagtttttatttaggattgtgttaatttttatatttttagttattgtttttttaatagagattatggtttttttagttagggattttgtttttgggaaatttatggttattatttggatttgaggtgttattatttaaattttaattttaggttttatttagtttatttgggtgttagaagttggtattatagtttttggttagatttgtttaatgatgattatttttggttatgtggagtttattgtagttgttattttttttataattattattaagaagttatgagtatttatattaaaattagtaatgtttttaattgattttattattattatgatttgtaggttaattaagaaattatggatattttggttagtgttttgggttattattaaagtttttattattagattggaaattgttttattgtttatttgtatttgtattattattagtggagtgttttgtggtggagaatttaattagtgtttagagtttaagaattatattgatagggtagatgtttgggttggtatttattttgaggtgaagattttgttagatattttttatgattatgaggatattattattgataagttgaagttgattttgaaattgtgggagtagtagttggtgggtgagaagttttgggtatagtttaatagtaatagttagtttatgtatggtttttttgatagtagttatgtgggtaaatatgagtattttatgtatgttatagataaggggggtttgttggttgtggatgtttttgagatttatgtttataggtgtttttaaggggatagggtttttgtaaggtttaaggttaagtttgtgggtgatttggtattggtgttgaatgatatttataagaagattgttttggtaaagaaattggtttttgtttttggagattgaaattgtagtattattattttgtagaatattatttggggttttattgtggtggaatggattaataatatattgtttttggagttttgttttaaggagtagattgttgggttgagttgttggattgttgaggatgatggaaaattttggtttgttttttttaatgttttagagtttgattttaaggttataagtattattgtgatgggttttggtagttgttggtatttatagtttatttttgtggtattatttaggagagtgtttttagaggtgttgtttatagaagtgtttgatagggattttgagaagagtagtgaggatgatgtttatttgtatatagttattttggttgtggtggttgtagttattttgtttattgttggtattattgttatgatttgttattgtaagaagtggaagggtaagtttatttttgaggattaggttatttttattaagaagggggtgtttattatttttgtagatgaattggatgattttaagtttttatttttttttagtatgttatttattttgtaggaggagaaggtttttttatttttttttgagtattttaattagagtgtgtttgagattatttttttgaattaggatattatgggagagtatatgtttttgtgggatgaggattttaatgtgtttttttattagtttttattgttttttatagtatttatggagggtaagggtttttgttttaagaatatgattttatattggttattttttttttatgttttattttaatttgtaagtgtttgggtggaggtagggtagggtaggggtttggagatgatatggtgttgtttgtggagattggtggtttgtagattattgtttattgggagttgatatttgatttagtatatattgatataggggtttggataagtttgttttttttggtttttttaaattttaaagtagttggagagattttggggatttttttatttttattttttgtttaatagtttttggtttgtttatagagaattttttgttttatttttgatggttggttttgaaagtattatgtggagtggaggtggagggagtgaggaattatgaatgaatttgtaggtagtgttgggtggttttttggttttttgtgttttgtttttaatattaattgtattgttttttttatttatgtgtgtttagttgtaggatgtaatatggaaaatagtaattaaagattaaatttaaaggatttttagaagttaaggttaagtttttatgtttaatttgttgtttatttaaatttgtatgtataatttttgggtgggtatggggaattgttttgttaaaaataagtttttagggtgttttaaatttagagaagattaagggatagtattttttattaaaggaatattatttttttatattatgttaatttggttgttttgatattttagagtttgattgggggttttttggttttggtttatgttaagtttttggtgttgggtttgtttttttgttgttgttaggggttggaagttggaggggttttttgggttatggatatttttatttttagtttatgtatattagtggtttatgattaaggggtttttatttttatgaaaaagggattttaagaggtagtggtggttgtggtttttaattttggtgttttagggtgggttagttgtttgtgggggtatttgggaggttaaaggtttttattatattaatttattttgttttattttttttttgtgtattgtttttttttttttttttaaaaggaatattatggttttttgaaatatttagtgggggatattttggtgaagatgtaatatttttatgttatgtgatgttttttttttatttgattttggttgttttgttttaatagtttatagttttgttttgatttattttattttttttttttggtattttagttttaggttttgggtttgaattattggaaaaggtttggtggttggggaggagtgttagtaatagtttataataaaaatttgttagtttttaaagttaattttttattaaagtttttatatagttttaaattgttttattaaaaaaaagatttaaaatggtgatgtttatagtagtttgtatgagtttttaagtgttgattttatggaattgatggttttgtttgttttgatttttttttttttattttttttaatggtttaaattttggaattatattggggtttttttgttttttttagtagaatatttgtttgtttatttgtatttttgttttatgatttaggggtgtttattttgttttgattttttttttgtggaagaaattattttgagtatgattttttttgatgtttgaagtgttattttgggtattttttagggaggaatgttttttgtaataatgtatttattttttgattgagggtgggtgggtggatttaggttttttttgtatatagagtagttatttttaagttatattgattgttttgtagaggatttgtgtgtgttgttttaggaggggagggttggtaggagggggggagaggtttttgttttattgttttttagagggtatttttttttgtgtttttttttatagggtttagttttttttttttgttttagtttttagggggtattttggagtgagtagtgtttttgtgggggagtttgtaaatgtgggtttagtggattattggtgattgggtttatgtttttaagttagagtttttttggtgttttagagataggagtataagtgggatttgatttggtgagattatttttgatgattttattaaaaaataaataatttttaatgttttaggtgagggttttgaaaggttttttaaatagttttgttgtttttagtaattttattattgggtattgttatgtagagatgtggttggtttagaatggtttgttgttatagtaattggaggtgatggggtagtgaatagaataataatagtaataatgtttttgtaggtagtttgtttttttgagtgttgggttggtgatggttgttggattttgtgagatggagagttaattttatatttaagtgtttattaattattgatgtgtttttatttttttttatatgattttaagatgtgttttttgtattttgtaaagaaatatattaaattaaataaaagtagtgtttttatt

SEQ ID NO: 445 - DNA, 4784 bp, Artificial Sequence
  chemically treated genomic DNA (Homo sapiens)
aataaagatattgtttttatttagtttgatatgtttttttatagaatgtagaaaatatattttaaaattatatagaaggaaataaaaatatattagtggttggtgaatatttgaatgtgagattggttttttattttatagagtttaatgattattattagtttagtgtttaggggagtaggttgtttgtaaaggtattgttgttgttgttattttgtttattgttttattgtttttagttgttatggtaataggttattttgggttagttatgtttttgtatggtagtgtttaatggtggagttgttaggggtgatggagttgtttggaaggttttttaaagtttttatttggaatattgggaattgtttattttttgatgaggttattagaaataattttattaggttagattttatttgtgtttttgtttttggggtattagggaaattttgatttggaggtatgagtttagttattagtggtttattgagtttgtatttataggtttttttataggggtattgtttattttagagtattttttggggattggggtaggggagaggggttgggttttgtgggagaaggtgtaaggggaaatgttttttggagagtagtaggatagagattttttttttttttttattagttttttttttttgaggtagtatatataaattttttgtaaaatagttgatatggtttagaagtagttgttttgtgtgtaaagggagtttgggtttatttatttatttttaattagggaatggatatattattgtgaaaggtatttttttttaaaaagtatttaaaataatgttttagatattaagaaaagttatgtttaaaatggttttttttataggaggagaattgaagtagagtgggtgtttttgagttatgggatagagatgtagatggatggatggatgttttgttaaaaaaggtaaaagaattttagtgtaattttagaatttaaattattaggaaaagtagggggaaaagaattaaaataagtaaagttgttagttttatggaattaatatttaagagtttgtataaattgttgtaagtattattattttaaattttttttttaataaaataatttgaggttgtataaaaattttagtaaaaaattagttttgagagttaatagatttttattatgaattattgttggtatttttttttagttgttagattttttttagtagtttaggtttaaggtttgggattggagtgttagagaaaagggatggggtgggttggggtaggattgtggattgttaggataaagtggttaaggttaagtgaggaaagagtattatatgatataaaaatattgtatttttattaaaatgttttttattgagtgttttaaaaaattgtgatattttttttaggaggaaaaaaaaaaataatgtatagaaaaagggtaaaataaaataggttgatgtggtggagatttttgattttttaggtgtttttataagtagttggtttattttggagtattaaagttgggggttatagttattattgttttttggagttttttttttatggaaatgaagattttttggttgtgggttattagtgtatatgggttggaagtggggatgtttatggtttaagagatttttttagtttttagtttttggtaatagtgggagagtaaatttagtattagggatttggtgtgagttagggttgggaggtttttaattaggttttggggtattagagtaattaagttgatgtagtgtgaaaaaatagtatttttttgataaaaaatattgttttttggttttttttaagtttgaaatattttgggagtttatttttagtaaagtaattttttatatttatttaaaaattatatatataagtttaggtaaatagtagattaaatgtaaaaatttaattttaatttttgaaagttttttgaatttaatttttagttattgttttttatgttatattttgtagttagatatatgtgaatagaaaaaatagtatagttagtgttaaaggtaaaatgtagagagttagggggttgtttggtattgtttgtgagtttatttatggttttttgttttttttatttttattttatatggtgtttttagagttagttattaaaaatgaagtgaagaattttttatgaataaattaaaagttgttaggtaaaaaataaaaataaaaaagtttttaaagtttttttagttgttttggggtttgggaggattagagagggtgggtttgtttaggtttttgtgttagtgtgtgttaggttaggtgttggtttttggtgggtaatggtttgtaggttattggtttttatagataatattatgttgtttttaggtttttgttttattttgtttttatttaggtgtttgtgggttaaggtgggatatagggaggaggtgattggtatggggttatgtttttgggatgggagtttttgttttttatgggtgttgtgaagggtggtgggggttggtagggaggtgtattgggatttttattttgtaggggtgtgtatttttttatggtgttttggtttagaggagtggttttgggtatattttggttggggtatttaggagggggtaggggagttttttttttttgtagaatgagtggtatgttggaggagggtgggggtttggagttgtttagtttgtttgtaaagatgataggtattttttttttgatgaaggtggtttggtttttaagggtaagtttgtttttttgttttttgtggtagtagattatggtaatgatgttagtaatgagtaggatggttgtgattattatggttggaatgattgtgtgtaggtagatattatttttattgttttttttagggtttttgttaggtatttttgtgggtggtgtttttgagggtatttttttgggtggtattatagggataaattgtaggtgttgataattgttagagtttgttatagtgatgtttgtggttttaaagttaggttttagggtgttggagaaggtaggttgaggttttttattatttttagtgatttggtggtttagtttagtgatttgttttttggggtagggttttaagggtagtgtgttgttggtttattttattatgatggagttttgggtgatattttgtagggtgatggtgttatagttttggtttttaaaggtgaaggttagtttttttattaaggtaatttttttgtggatgttatttaatattagtgttgggttatttataaatttggttttgaattttgtaggagttttatttttttgggggtgtttgtggatgtggattttgaaggtatttatagttgataggttttttttgtttgtggtatgtatgaaatatttgtgtttgtttatgtggttgttgttgggaaggttatatatgagttggttgttgttgttgaattgtatttaggattttttgtttattagttgttgtttttgtagttttagggttagttttagtttgttagtggtggtgtttttatggttatagaaagtgtttgatgggatttttattttaaagtaggtgttaatttaggtatttattttgttaatatggtttttgagttttgggtgttggttgggttttttgttatggggtattttattggtggtggtgtgaatatgagtaggtggtgaggtagtttttaatttggtgatggaaattttggtggtgatttggggtattggttggggtgtttgtggttttttggttggtttgtgagttgtggtggtggtggagttagttgaaggtgttgttggttttggtgtggatatttgtggttttttggtggtggttgtgggaggggtagtaattgtagtaggttttatatagttaggaatggttattgttgggtgaatttggttaggaattgtggtgttagtttttgatatttgagtaggttggatggggtttagggttggggtttgaataatggtgttttgagtttggatggtgattgtgggttttttaggaataggatttttgattggaggagttatggtttttgttggaggagtaatggttggagatgtgggggttggtatgattttggatgggggtttttggatagttgtggttgggggtttaatggtagtgataggtgtgggtgtagtatggatttgtttttggatgtgtttgggaagagggggttttttattggtgatgtgttaatttattatagggtagttaagttgagtagatattgtgttttttttggtaggggtttttatattatgaatgttaggtatattgttttggtttagggagtagtttagtttttaggagagaagggttttattttttattattttttttgtattttttgggttagttatgaaggttgatatgttaaatagtttgttatttattattggtattaattttatgttgtgaagttttatttttgagaagttttgtattttgtgtaggaggttaattttttgttttggggttattttggtgaggttggtatttaaaattattgttaaaatagttataggtttatttgtagtataggtagatgatattattttattagggtttggggaggttgtttttattgattgtagtttattgtggtttttagggtagattttgatggagaatatattggaggtttgggggatgtggtttttgttggtttttagttgtgtagtgtttattgaaatgtaatgtatatttttattagtgttaagggggaggttttttagggtgtggttttgtgagttttagtgtagttaag

SEQ ID NO: 446 - DNA, 4337 bp, Artificial Sequence
  chemically treated genomic DNA (Homo sapiens)
tagtatgaggaaatttagttgtaagaaaggagatttgggattatgtgggtgttgtgtttatttttttgatagtatttttgttgtgggagtagatgtggtagattttgaaagttgggaggagaggaaaagaggtgttttgaggaggttgattttggttgggggtgaagaggagtttttttgtaattgtagtaaatttatggagtgatggtttttattgttatggaaataattagtagaggtttttatttttttggatttttaattataggaggaattattatatttttttgtaattttgtgtatatttaggaaaagttgaagtagtttttttaaaattatttattttttgagattattgtttagatagtttttatgttttgtttgttttttaatgttgttgggatttattaaattgattttagaatttgttaatggtttaggttgtagttggaaatttttggttttagtagagttgaattttatttgtggagatgttaggagttaggaggattaggggtgggtgtttttgggtttttattttagttttaggggttttttttttttgttgggttatgtgtaggttgtgaaggttttatttttttagtagtatattaaattttattattttatttaagttaattttgttttttttttatttgagggttttgtgtggatagaatattaagtggataagtttgtagggtgtttagattaagtgttgagtttgtagtgaatgtttagttatgatttgtagtggattgatttgtgtaaaaattggatttttaagttgttagttttagtgttagtatgagtttggttgagtttatttggttgtaggaataagggggttgttaggagtaagagtggagggggtgtttaaagggaggagattaaggtttaattattatttgttttttaattttttaggtgtatagtggggatgtagtgtgtttttaaattaatgttattagtagagggttttagaggagttggaaggggttagggtttgggtggtggtgggagggtttgagtagtgggggtggggagttgggggttggtttttgtttgtgttttagtgttttggtggttgttggggttattgattttgggtttggtttttgtggtagtgttttgagttgttgttttttgtgttgttagtgtttgggaaggaggaagggggaagggggtgggttggttgggtttatggttgatttttttttttagttttgttttttgttgtttgtgggtgagttttgtttaagttgaggttgtggggttggtgttggtgggaggattgtggtgttttgtggaggggttgagtttgttagggtttatttgattttgttttttattttttgttttttaggtttggaggtgggggtttttggggtgatttgggggtggattgtggggtggagttgttgtttgtgagtttggttgagttatttgagtttgagttgtgggatattgttgtttttgttttttgaatgttgtgtattgtgatgggtttgaggagttggtttgttgttttatggggtgtgttgttgttttggttattgttgttgttgtttttgttgttgttgtttttgttgtagttgttgtttttgatttgggtgtttagtttttggattagtttgtttttgggtgagtgttggggatttggggatgtgggttgggggaaggaaggttgttggggatgtgttttgtgtggaggtggttgtgataaaggattaaggaggggatttgttggaggtatgggatttattaggattttttttttttttaaggtgttgtgtggagggagggagaggagaggggagttgtggggttgttggtttttttttttagttttttttttgtgtagggatggggtttagtttgttttgttgttttttttagtttttttaggaggatgtatttttggtggggtttgtttgtttatttatttgtttttgatgttgattagagttgattgtggtgttgtttttgagggtggtttggggtagagggaggttattgtttgtagttttataaatattggggttttggtatttttagtaagttgtagtagggttgggagttgtggtgggtgggtaggtgtttgattttttttttttgtttttttatttttggtttgttagtgtagttttaagttttagtatggagagatttttaggttttgggagtgattagattgtggatgggggtagttttgggtgttgatatttttaagttttgggagtgaatagattgtggatgggggtagttttgggtgttgatatttttaagttttgggtgtgatttttttttagagtgatttgggagtagtattttggttggttgggttttttttttggtttttatatttgtttttgtggttattttttgttttagttttttgttttttttttttttttttttttttatttggttgtttttttagttttttttggggtatttgggttttagatttagagggttttggattttaagtttattttttttattgggtaagtaagtgttttttgtttttagtgttttattttttttatttgtaaaataggtagttgtaggtgttttgtaaggtgtgttatttgggtatgaagtttataagtgtttaatagatgtatttgtaagttttttaatttgttggttgttatattgtatgatttggaataaagtatgtatgaattagaggttatagattgaaattgttttagatttttatttttttatagtatttttatttttaaaagtattttgtttataaagggaaatagtagaattagtatttaaattaaggtagggttttagtggttttaagtaattttatttgaatttttgtttgaaatattgtagatgatttgggtttaaatgttattttagttatttagtaattatgtgattttgagtaggttatttaaagtttttgggttttgatttttttatttgtaaaataggtataataatagaatttattttaaggtagtgaggattaaattagtttgtgtttgaaaagttgttaggatagggtttggtatgggaattgttgaatgagtgttatttagtttagagtttatttttgtatattttgtttagatttggggtgattttgtttggggttaggatagggttggggtgttagtttgattgtagttttttgggtgttttagtttgtgaagttaggatgaataggtgtaattagttttaggtttgttgttttgttatttttgttgtggttataattttttttgtttttagatttttttatttttgggagaaggtagggtgagatgggggtagatgttttaatggattttatttatggttttgggaaagttgggttagtttatgggattatgttaaaagatggtaggttttatgtttaattttggaattggatgggataattatagggtagttagaaggtaaaattggagagtagtgaggggaattgaggggatttgttttttgaggagtagttagaatatttggttattattattaatgtagttgtaggatttggtttatttttataagtttgtgattgtttttaggtttttgttatgtattagtatttatttgttagggttgttgtaggtgggtttgtattttgtgtattgtattaaggtgtttagttgagggttgagaggatttgaaatgtagtttatatttagttttttaatttaagagttttggagtaaaagattttttttgttatgtttttggggttaggtttgtttggagtggtttatttttttagttttattaaagttttggaatagtgtagtggtatttagttatttgaatttgtgagtatgtatttatagttgattgagttgttattatattttggagtgttttttttttgggtttttttttggtttttatatttattttttatttttatttatgtgtaggttttagggttggttgggagtttgagaggggaatgttttggtaattgaataggtttatttttgagtgtggtttaaggtggttttttgttttattttagggggtttattagatgtttttggtagtgtgtttattttgggtaggtttgtggtgattatgggatgttgggtttagggttttagtgtttttttttgtatgtattttaggagaaagagttatggaattggatattatatatttttttttttttttgttatttatttttttattgaatttttatttatgttttgtaaggatttagatgtttagggatagtggggttatgtttgtggtttaaaataaaattttttgaagtggagtgtttagtttgttttgtatttggggttttttatagggaattttaattattgttgatgaat

SEQ ID NO: 447 - DNA, 4337 bp, Artificial Sequence
  chemically treated genomic DNA (Homo sapiens)
gtttattaataataattagggttttttatgaaggattttagatgtagggtaagttggatgttttattttaagggattttgttttaaattatagatatagttttattgtttttaggtatttgggtttttatggggtatgggtgggaatttagtagaggagtgagtggtaggaggaaagaggggtgtgtaatatttagttttatgatttttttttttaagatgtatgtaagggagggtattagggttttgggtttggtgttttatggttattatgagtttgtttaggatgggtatattgttaggaatatttaatgagttttttgggatgaggtaggaaattgttttaggttatatttaagggtgagtttgtttagttattagggtattttttttttggatttttagttagttttaggatttgtatgtaggtaagagtaggaggtgggtatgagggttaggaggaagtttagagagggggtattttagggtatagtggtaatttagttgattatagatatgtgtttataagtttaggtagttaggtgttattatattattttagggttttggtgggattggaaaaatgggttattttgggtagatttagttttaagaatatagtagaaggggttttttgttttaggatttttaggttggagagttgagtgtggattgtattttaggtttttttaatttttagttgggtattttggtataatgtataaaatgtaagtttatttatggtagttttgataggtgaatgttggtgtgtgatagaagtttgggaatagttatgggtttgtagaagtggattaggttttgtagttgtattggtaataataattaagtattttagttgttttttgggaagtaggtttttttgattttttttgttgttttttagttttgttttttagttattttgtgattgttttatttagttttagagttggatatgaaatttattgttttttgatatggttttatgagttggtttagtttttttaaggttataagtggagtttattggagtatttgtttttattttattttgtttttttttaaaaatgagagggtttgagggtaaagggagttgtggttataatagaagtagtaagatagtaggtttggggttggttatatttgtttattttgattttataagttgaagtatttaaggggttatagttaaattaatattttaattttgttttaattttaggtagaattattttagatttgggtaagatgtatagaagtaaattttgagttgagtaatatttatttagtggtttttgtattaggttttgttttaatgattttttaaatatgagttgatttaatttttattattttgaggtaggttttgttattatatttgttttatagatgaagaaattaagatttagaaattttaagtagtttgtttaaggttatatggttattaagtggttgaggtagtatttgaatttaggttatttgtagtattttagataggggtttaggtagggttatttgaagttgttagggttttgttttaatttaagtgttgattttattatttttttttgtaaataggatgtttttagaggtggggatgttgtgaggagatggaagtttgggatagttttagtttgtaatttttaatttatatatgttttattttaagttatataatatgataattaataagttaaagggtttgtggatatatttgttgggtatttataaattttatatttgagtaatatattttgtaaggtatttatgattgtttattttgtagatgagaaaggtggggtattgggagtagaaggtatttatttgtttagtggaagaaatgggtttgggatttaggattttttgaatttaaagtttaagtgttttaagaagagttggagaagtaattggatggaagggaaaaggagagggaagggtggagggttgaaataggaggtggttatagaagtagatgtgaggattaggaaaggaatttagttaattaggatgttatttttaggttattttgaggaggggttgtgtttaggatttgggaatgttagtgtttagagttgtttttatttgtagtttgtttgtttttaggatttgggaatgttagtgtttagagttgtttttatttgtagtttggttgtttttagggtttggaggtttttttatgttggggtttggggttgtattggtaagttagggatggaggggtggagagggaggattgggtgtttgtttgtttattatagtttttggttttgttgtgatttgttgggaatattagaattttagtgtttataggattgtaagtagtggtttttttttattttgagttgtttttgggggtggtattgtggttggttttggttagtattaaagataagtagatgggtaggtggattttgttgaaagtgtatttttttaagggaattaggggggatgatagagtgggttagattttatttttatgtagaaagaaaattgaagaaaggggttagtggttttatagttttttttttttttttttttttttgtgtagtgttttgaaaaaagaaggggttttaatggattttgtgtttttgataggttttttttttggttttttgttatggttatttttgtatgaggtatgtttttggtagtttttttttttttggtttgtgtttttgggtttttggtatttatttagaggtaggttgatttgggggttgagtgtttaggttggaggtggtggttgtagtaggagtagtagtagtaggagtagtagtagtggtggttgaggtggtagtgtgttttatggggtggtgagttagttttttaggtttattgtggtgtgtagtatttggagagtaggagtgatggtgttttgtggtttgggtttaggtggtttggttggatttatgggtggtagttttgttttgtggtttgtttttgagttgttttgggggtttttgtttttggatttggggggtgggaggtgggaaatagggttaagtgggttttggtaaatttagtttttttgtggggtattgtagtttttttgttggtgttggttttgtagttttggtttgggtagagtttatttgtaagtggtggagggtggggttgaaggaggaagttggttgtgagtttggttggtttgttttttttttttttttttttttttgggtgttggtagtgtgaggggtggtagtttggggtgttgttgtaggggttaagtttgggattagtagttttggtggttgttggagtgttgggatgtggatgaaagttgatttttagttttttgtttttattgtttagatttttttattgttgtttaggttttggttttttttggtttttttgggattttttgttagtggtgttggtttggggatatgttgtgtttttgttatgtgtttagggagttagggggtggatggtgattaggttttggttttttttttttaggtgttttttttgtttttgtttttggtgatttttttgtttttgtgattaaatgaatttggttgagtttgtgttgatattggggttagtagtttgagagtttaatttttgtataggttaatttattgtaagttatggttgggtatttattataagtttagtatttagtttaggtattttgtgggtttgtttgtttaatattttgtttatgtgaagtttttgggtgggggaagggtaagattagtttaagtgggataataggatttaatgtattgttgaggaggtaaaatttttataatttgtatgtgatttggtaggggaagggaatttttaagattggagtggaagtttagaggtatttatttttaatttttttggtttttaatatttttatgggtggagtttagttttgttgagattaggggtttttaattgtagtttggattattagtagattttgaaattaatttagtggattttaatagtattaagaaataaataaaatatagaaattatttaagtaataattttaaaggataagtaattttgggaaagttattttaattttttttaagtgtgtataggattatagaaaaatgtagtagttttttttgtagttaagagtttaaaagagtgaaagtttttgttagttatttttatggtagtagagattattgttttataaatttgttgtaattgtaggaaagtttttttttatttttagttaaaattagtttttttagagtatttttttttttttttttttgatttttagggtttgttatatttgtttttataatagggatgttgttaagagggtgggtatagtatttatatggttttaggtttttttttttatagttaagtttttttatgttg

SEQ ID NO: 448 - DNA, 4388 bp, Artificial Sequence
  chemically treated genomic DNA (Homo sapiens)
agttatgagtggattagatgttaaaatttttggttgagagaataattttattttggaggaaaatatattagttttgattttgagttgggaattttggtgatgttgtagatttaatgtattgtagttgggtgtttttatttgttgaaaggaattgttgaatttttaaatttattaattgtttgttagtattagtaagtttaattagttaatattaagtaaatttgtattaaatatataattttggttgattttattggttatgtttggtagagggtagtagtagggagaaagttttgtagagtttttgttggaattgtgtgaaaagttggagaggttgtttttttttttttttttttttttttttttttttttttttgatatatatatatatatatatatatatataattgtaataataataatattttggttttttattaagttaatttaaattgtagaagtttattttgttaagtaagtttggttttagttatatgttgttatttagagaatttaatattagattttatttgattgtaaatgtgaattattaggttgtataaggaatatagtggtagatttagggggtatttaatttttatagtattttaaatgaaaaaaaaaaaaagtaatatttaaataagtaatttagattatgttgtaggttttgaatagttttgatgttgtgtttttatggtaagtttttaatttgagttgaatttttttttattaaaaatgtaaatttttttaagatttttttttggttttgttatttatgatatatattttttttaaaagaaattttaaattagataatagttgtttttttttttatttttgttattagtagtgtggtggggtagtagagttgtggttagtggaggagagtagaggaggagagtagggaaaggagaatgttatttgtttatatttttttttgtttattttttgttgtttatttttttttttgtttttttgaatgtgaattgagttttgggtattgttttaggtttagtaggggataggataaagtttgtttttttaggaatttgtattgagggtgtgagtgtgtgtatgtgtgtgtttggaggtgggagaataaatataaataaataaaaaggagaattttaggtagtgataagagtgttgagaaaaatagaatggtgtgaaagaggaaggttgagtttgtagaggtttgaggttgttgttattgggtagtggtaggtttttttgaggaggtggtatttgaagattggaggaaggtttattttagtaagtaggaatagtaagtgtaggttttttaagttttgggggagtttagtttttttaagggtagtataaaaattagtgtggttttggagagtatattaggggagagaggtaggaagagtttggagatatggatggaagttggattagttgggttttgttgaatatggaaaggtatttagattgtattttgagttaaatgggaagtgatgtgagagatttaataatggagtgttttgaattgttttatttatttaaaatatttatttttgtttggttgaatattttatgttgtttttttagaagttttggtgattttatttgaatgtatttaggttttattggaggggaataggattttatttgaggttatggaggtttatggaagttatttgtatagtaaatattttgaaagtggttgtagggagagtgtgagggtgggattgttttggtaggaggtggaaaatgaaaaatatatggttatgagttttagattagggtttttgaaagtttttagtttttttagtttttattttaaagtgggtttttaaataggaagaaagaaagattgttaagtgtttttggagttttttttttttttttttttagggattttagtatttttggggtttgggttggttttaaagtagttttttttgtgtttttttatttatagtaataaaggtatggagtatttgtatagtatgaagtgtaagaatgtggtgtttttttatgatttgttgttggagatgttggatgtttattgtttatatgtgtttattagttgtggaggggtatttgtggaggagatggattaaagttatttggttattgtgggttttattttattgtattttttgtaaaagtattatattatgggggaggtagagggtttttttgttatggtttgagagttttttggtttttatatggtttagataatttttgttgtattttatttttattatgtattattttagttaaattttgttttttgtatatattttggtatgtatttaatattaatggttttttagatgagtggttatttatttgtttgtttagtttttagtggtatattttttgttttttgttgggaatagttaaagggattttaaggttaaatttttgtaatagtttttttttttttttgttatgttattaagtgtgaggatttttgtagttttttatagttgaatttagtttatgggttggggtttagataattttgtgtatttaagttatttgtagagatttaggtttggagagtagatattttgtttttgataagtattttttaaatggttttaagaataagttatagtaaagaatttaaagtggtttttttaattggtgatttggagaaagttaggttaagggtttattatagtatttttttgtatttttatggtaatgtatttttttatgaaagtggtatattttaaagtttttatatgattgtagtagagtatttggtgattgttaatttattttttttataggaatataaggggtatatagggaaggtagattttttagttggtaagattattttaatttgatatattgtagatttagatgtgttgaaagttttgtttttggttttttggttatgggttttagttaatttatgttttttatggatttatggagagtagtaagttgattttagttaagtttttttatatgagggataagtttttgatttttgtttttatttttgtgttataaaagaaagttttttttttttgaatttgtagtaaggttagttttaggatttgttttagtgggtattgtatttggatttttttggtgtgtgtgtgttttatataggggtgaattgtttattgtggtgatgtatgatgagggtaaatggtagttgaaaggagtaggggttttggtgttgtatttagttttggggtatggagttgaatagtatttgtgtaggattgttgtggttattagagaataagagggaaagtagggtagaaattggatatagttttgaggtatagttagatttgtttagggtggttttgttataggttgtagttatttaggaatattttttgtagattttgtattgttttttgggggtgttttgggatttttggggtagtttagtttttttttattttttagtgtggttttggttggaagaagtagttgttatagttgttgtagatagttgtgtttttataattggtttagtattttggggtatgggagaagggtggggattgttgttgttattatttaggttgattggggtttggttagattatgtatgtttttggtggtttagagataatttaaaattagggtttggtttggggaagaaaatttttttttttttttttttgttttgttttttattgtttttatttttgttagtttattttttttaattttttttgatttataggttaaaaaagaaaggtttattttagttatagggtagttttttttgggtttttgtttttttagtataattatgggttatttttttttttttaataaaaaagaatgtttgattttttttgggtgattttattgtttgtaattgaaattttattgagaggtgatgtttgtgttagttaatgatttaggtgagttgtttgggttttttttggtatgttttgtttggaaaagtggattttatttatttttgattgtttagttaagtgattattaaaggattgagaatttgggagggtaaaaaaaaaaaaaaagtttttatgtgtatttaaatttggggataattttatgtatttgtgttaaggatatgtttaagaatataatttttttgttgttgtttgtttaagaagtattttagtttgtttaagaagtattttatatagtataatatatatttttttgaaattatattgtttgtttattagataattgaatgtagtaattttgttttggatttaatttgattgggttaatatgtaaaaattaaggaaaaatatttagtttttttttttttttttgtatattttttaagttattttgttatgtatatagttatttatgtttaaagtttggtgattatttatttaaatgaagattatattttatattaatttttgtatttatagtagataaaatagtat

SEQ ID NO: 449 - DNA, 4388 bp, Artificial Sequence
  chemically treated genomic DNA (Homo sapiens)
gtgttattttgtttattgtggatataaaagttgatatgaaatgtgatttttatttaaatgaataattattaggttttaggtataaatgattgtatatatgataaggtagtttgaaaagtatataaaaaaaaaaaaaaaaattaaatatttttttttggtttttgtatgttaatttagttaaattaaatttagaatagaattattatatttaattgtttgataaataagtaatgtaattttaaaaaaatatatattatattatataaggtgttttttaaataaattaaggtgttttttaaataaatagtaataaaagaattatgtttttaaatatatttttaatatagatatataaaattgtttttaaatttaagtgtatataaaaattttttttttttttttgtttttttagatttttagttttttggtgattatttaattggataattagaaatgaatgaaatttatttttttaaataagatatattaagagaagtttgagtagtttatttgggttattggttaatatagatattattttttaatagggttttaattatagataataaggttatttagaggaaattaaatatttttttttgttaagaaaaaggaagtaatttataattgtgttagagaagtaaaggtttagggaaggttgttttgtggttggaatgagttttttttttttagtttataggttaaaggaaattgaaggaaatgagttggtaggagtggaggtggtagggaatggggtgggggaggaagggggaggatttttttttttaaattaaattttgattttggattatttttaaattattaagggtatatgtaatttgattaggttttagttagtttgagtagtgatagtaatggtttttattttttttttgtgttttagggtgttgggttaattgtaggaatatagttgtttatagtagttgtgatagttgttttttttaattagggttatgttgggaaatgaagaagagttggattattttagggattttagggtatttttaaagggtaatgtggggtttgtaaggaatgtttttaggtagttgtagtttgtggtagggttattttgagtaagtttggttgtgttttagaattgtatttagtttttgttttatttttttttttgttttttagtagttataataattttgtataagtattgtttagttttatgttttagggttaaatgtaatattagggtttttgttttttttaattattatttatttttattatgtattattatagtgaatagtttatttttgtgtaaggtatatatatgttgggaagatttaagtatagtgtttattggaataggttttgaagttgattttattgtaagtttagggagggagggtttttttttgtaatataaaaataaaaataaaaattaggaatttattttttatatagggagatttaattaagattaatttgttgttttttataggtttatgggaggtatgaattaattggaatttatgattggaaagttagaggtagagtttttagtatatttgaatttgtagtgtattaagttaaaatagttttgttaattaggggatttgttttttttgtgtgttttttgtatttttatagggggaatgaattgataattattagatattttgttatagttatataaaagttttaaggtgtattatttttataaaaggatgtattgttataggaatataagagggtgttataataaatttttgatttagttttttttaagttattaattaaaggagttattttaaattttttgttgtggtttatttttagagttatttaaaaagtgtttattagaggtaaaatgtttattttttaggtttgggtttttataagtagtttaaatgtatagagttatttgagttttaatttatagattgagtttagttgtgaagagttatgggaatttttatgtttagtaatatagtaagggggaaagagagttgttataaagatttagttttggaatttttttggttgtttttaatagaagatagaagatgtgttattaagaattgagtaagtaaatgaatggttatttatttagaaagttattggtgttggatgtatgttggagtgtatgtaggagatagaatttggttaaagtggtgtatgatgagggtaaaatgtagtagggattatttgaattgtgtgggagttagggagtttttagattgtggtagggaaattttttgttttttttgtgatgtaatatttttgtaaggaatgtgatgaagtagagtttgtagtggttaagtggttttggtttgttttttttatggatgtttttttatggttagtgggtgtatgtaggtggtgggtgtttagtatttttagtagtaggttatagaggggtattatgtttttgtattttatgttgtatagatgttttatgtttttgttattgtaggtgggaagatatagaaaggattattttagagttaatttgagttttaggagtgttgaaatttttagaaggggaaggaagaggaattttaaagatatttagtaatttttttttttttttgtttaaagatttattttaggatgggagttgggaaagttgagggtttttagaagttttaatttggaatttatggttgtgtgttttttattttttattttttattagggtggttttatttttatattttttttgtagttatttttagggtatttgttatgtaggtgatttttatggatttttgtggttttaaatgagattttatttttttttaataggatttaaatgtatttaaataggattgttaaagtttttaaaaagataatatgagatatttagttaagtaggagtgggtattttaaatgagtaaagtagtttaagatgttttattgttaaattttttatgttattttttatttaatttagaatatgatttaaatgtttttttatgtttaataaggtttaattggtttagtttttatttatgtttttaagttttttttgttttttttttttaatgtgttttttggagttatattgatttttgtgttgtttttaaaggaattaagtttttttaagatttaggggatttatatttgttgtttttatttgttgggatgaatttttttttggtttttaaatgttgtttttttggaaaggtttattgttatttagtggtagtagttttaagtttttgtaggtttagttttttttttttatattgttttgttttttttagtatttttattattgtttgaaatttttttttttatttatttgtgtttatttttttgtttttaaatatatatgtgtatatatttatatttttagtgtgaatttttagagaagtaggttttattttgttttttgttaggtttaaaatagtgtttagagtttagtttatgtttaggaaaataaggggggaaatgggtagtgggaaatgggtagagggaaatgtaggtaaatggtatttttttttttttattttttttttttgtttttttttattagttataattttgttgttttattatattattggtggtgggggtggggaggagaataattattatttagtttgaaattttttttaaaagaaatatgtattatgagtagtaggattaagagaaggttttagaaaaatttgtatttttagtaggggaaaatttagtttaagttggagatttgttatgaaaatataatattaaagttatttagggtttatagtatgatttaaattatttgtttaagtgttatttttttttttttttatttaaaatgttataaaagttaaatgttttttggatttgttattgtgttttttgtgtaatttgatgatttatgtttatagttagatgaaatttgatattaaattttttgagtagtaatatatggttggggttaagtttatttaataaaatagatttttgtgatttagattggtttagtgaggaattaaaatattattattattataattgtgtgtgtgtgtatgtgtgtgtgtgtgttagagagagagagagaaagagagagagagagaaagagaagtaatttttttagttttttatatgattttaatagaaattttatagagttttttttttgttgttgttttttgttagatgtggttagtaaaattagttagggttgtatatttagtgtaaatttatttagtattaattaattaggtttgttaatgttgataagtagttaatggatttgaaaatttagtaattttttttaataaataaaaatatttaattgtaatgtattgaatttataatattattgaaatttttagtttagagttaaagttaatatgtttttttttagggtaaggttatttttttagttagggattttggtatttaatttatttatggtt

SEQ ID NO: 450 - DNA, 20 bp, Artificial Sequence
  Detection primer for EGR4
agggggattgagtgttaagt

SEQ ID NO: 451 - DNA, 20 bp, Artificial Sequence
  Detection primer for EGR4
cccaaacataaacacaaaat

SEQ ID NO: 452 - DNA, 22 bp, Artificial Sequence
  Detection primer for APC
tcaactaccatcaacttcctta

SEQ ID NO: 453 - DNA, 25 bp, Artificial Sequence
  Detection primer for APC
aatttatttttagtgttgtagtggg

SEQ ID NO: 454 - DNA, 20 bp, Artificial Sequence
  Detection primer for CDKN2A
ggggttggttggttattaga

SEQ ID NO: 455 - DNA, 20 bp, Artificial Sequence
  Detection primer for CDKN2A
aaccctctacccacctaaat

SEQ ID NO: 456 - DNA, 22 bp, Artificial Sequence
  Detection primer for CSPG2
ggataggagttgggattaagat

SEQ ID NO: 457 - DNA, 22 bp, Artificial Sequence
  Detection primer for CSPG2
aaatctttttcaacaccaaaat

SEQ ID NO: 458 - DNA, 22 bp, Artificial Sequence
  Detection primer for ERBB2
ggagggggtagagttattagtt

SEQ ID NO: 459 - DNA, 22 bp, Artificial Sequence
  Detection primer for ERBB2
tatacttcctcaaacaaccctc

SEQ ID NO: 460 - DNA, 25 bp, Artificial Sequence
  Detection primer for STMN1
gagtttgtatttaagttgagtggtt

SEQ ID NO: 461 - DNA, 22 bp, Artificial Sequence
  Detection primer for STMN1
aacaaaacaataccccttctaa

SEQ ID NO: 462 - DNA, 21 bp, Artificial Sequence
  Detection primer for STMN1
gaaaggtagggaaggattttt

SEQ ID NO: 463 - DNA, 22 bp, Artificial Sequence
  Detection primer for STMN1
cctcttactaacctcaaccaac

SEQ ID NO: 464 - DNA, 22 bp, Artificial Sequence
  Detection primer for STK11
taaaagaaggatttttgattgg

SEQ ID NO: 465 - DNA, 21 bp, Artificial Sequence
  Detection primer for STK11
catcttatttacctccctccc

SEQ ID NO: 466 - DNA, 22 bp, Artificial Sequence
  Detection primer for CA9
gggaagtaggttagggttagtt

SEQ ID NO: 467 - DNA, 22 bp, Artificial Sequence
  Detection primer for CA9
aaatcctcctctccaaataaat

SEQ ID NO: 468 - DNA, 18 bp, Artificial Sequence
  Detection primer for PAX6
ggaggggagagggttatg

SEQ ID NO: 469 - DNA, 22 bp, Artificial Sequence
  Detection primer for PAX6
tactatacacaccccaaaacaa

SEQ ID NO: 470 - DNA, 20 bp, Artificial Sequence
  Detection primer for SFN
gaagagaggagagggaggta

SEQ ID NO: 471 - DNA, 19 bp, Artificial Sequence
  Detection primer for SFN
ctatccaacaaacccaaca

SEQ ID NO: 472 - DNA, 22 bp, Artificial Sequence
  Detection primer for S100A2
gtttttaagttggagaagagga

SEQ ID NO: 473 - DNA, 22 bp, Artificial Sequence
  Detection primer for S100A2
acctataaatcacaacccactc

SEQ ID NO: 474 - DNA, 22 bp, Artificial Sequence
  Detection primer for TFF1
ttggtgatgttgattagagttt

SEQ ID NO: 475 - DNA, 22 bp, Artificial Sequence
  Detection primer for TFF1
taaaacaccttacattttccct

SEQ ID NO: 476 - DNA, 22 bp, Artificial Sequence
  Detection primer for TGFBR2
gtaatttgaagaaagttgaggg

SEQ ID NO: 477 - DNA, 22 bp, Artificial Sequence
  Detection primer for TGFBR2
ccaacaactaaacaaaacctct

SEQ ID NO: 478 - DNA, 23 bp, Artificial Sequence
  Detection primer for TP53
ttgatgagaagaaaggatttagt

SEQ ID NO: 479 - DNA, 23 bp, Artificial Sequence
  Detection primer for TP53
tcaaattcaatcaaaaacttacc

SEQ ID NO: 480 - DNA, 24 bp, Artificial Sequence
  Detection primer for TP73
agtaaatagtgggtgagttatgaa

SEQ ID NO: 481 - DNA, 25 bp, Artificial Sequence
  Detection primer for TP73
gaaaaacctctaaaaactactctcc

SEQ ID NO: 482 - DNA, 22 bp, Artificial Sequence
  Detection primer for PLAU
gagagagatagttggggagttt

SEQ ID NO: 483 - DNA, 25 bp, Artificial Sequence
  Detection primer for PLAU
caaacaaacttcatctaccaaatac

SEQ ID NO: 484 - DNA, 20 bp, Artificial Sequence
  Detection primer for TMEFF2
tgttggttgttgttgttgtt

SEQ ID NO: 485 - DNA, 19 bp, Artificial Sequence
  Detection primer for TMEFF2
ctttctacccatcccaaaa

SEQ ID NO: 486 - DNA, 22 bp, Artificial Sequence
  Detection primer for ESR1
ttgttggatagaggttgagttt

SEQ ID NO: 487 - DNA, 21 bp, Artificial Sequence
  Detection primer for ESR1
ctatcaattcccccaactact

SEQ ID NO: 488 - DNA, 22 bp, Artificial Sequence
  Detection primer for SYK
gtgggttttgggtagttataga

SEQ ID NO: 489 - DNA, 20 bp, Artificial Sequence
  Detection primer for SYK
taacctcctctccttaccaa

SEQ ID NO: 490 - DNA, 23 bp, Artificial Sequence
  Detection primer for HSPB1
aagagggtttagtttttatttgg

SEQ ID NO: 491 - DNA, 22 bp, Artificial Sequence
  Detection primer for HSPB1
cctacctctaccacttctcaat

SEQ ID NO: 492 - DNA, 22 bp, Artificial Sequence
  Detection primer for RASSF1
agtgggtaggttaagtgtgttg

SEQ ID NO: 493 - DNA, 19 bp, Artificial Sequence
  Detection primer for RASSF1
ccccaaaatccaaactaaa

SEQ ID NO: 494 - DNA, 21 bp, Artificial Sequence
  Detection primer for TES
aggttggggattttagttttt

SEQ ID NO: 495 - DNA, 22 bp, Artificial Sequence
  Detection primer for TES
accttcttcactttattttcca

SEQ ID NO: 496 - DNA, 21 bp, Artificial Sequence
  Detection primer for PITX2
gtaggggagggaagtagatgt

SEQ ID NO: 497 - DNA, 23 bp, Artificial Sequence
  Detection primer for PITX2
tcctcaactctacaaacctaaaa

SEQ ID NO: 498 - DNA, 22 bp, Artificial Sequence
  Detection primer for GRIN2D
atagtttgtggtttggattttt

SEQ ID NO: 499 - DNA, 22 bp, Artificial Sequence
  Detection primer for GRIN2D
aaaacctttccctaacttcaat

SEQ ID NO: 500 - DNA, 21 bp, Artificial Sequence
  Detection primer for PSAT1
gtaggtggttaattttgggtt

SEQ ID NO: 501 - DNA, 23 bp, Artificial Sequence
  Detection primer for PSAT1
ctcattcacactatatccattca

SEQ ID NO: 502 - DNA, 22 bp, Artificial Sequence
  Detection primer for PSAT1
taagagagaggagttgaggttt

SEQ ID NO: 503 - DNA, 22 bp, Artificial Sequence
  Detection primer for PSAT1
ccaaaattaaccacctacctaa

SEQ ID NO: 504 - DNA, 24 bp, Artificial Sequence
  Detection primer for CGA
tagtggtataagtttggaaatgtt

SEQ ID NO: 505 - DNA, 22 bp, Artificial Sequence
  Detection primer for CGA
tccacctacatctaaaccctaa

SEQ ID NO: 506 - DNA, 21 bp, Artificial Sequence
  Detection primer for CYP2D6
ggggttaaggtttttatggta

SEQ ID NO: 507 - DNA, 22 bp, Artificial Sequence
  Detection primer for CYP2D6
cctcctaaactaaatccaacaa

SEQ ID NO: 508 - DNA, 22 bp, Artificial Sequence
  Detection primer for COX7A2L
ggaggtgtaaggagaatagaga

SEQ ID NO: 509 - DNA, 25 bp, Artificial Sequence
  Detection primer for COX7A2L
aatcctaaaaaccctaacttttaat

SEQ ID NO: 510 - DNA, 22 bp, Artificial Sequence
  Detection primer for ESR2
tagaggggagtagtgtttgagt

SEQ ID NO: 511 - DNA, 22 bp, Artificial Sequence
  Detection primer for ESR2
aaaccttcccaataacctctta

SEQ ID NO: 512 - DNA, 22 bp, Artificial Sequence
  Detection primer for PLAU
gtgatatttggggattgttatt

SEQ ID NO: 513 - DNA, 20 bp, Artificial Sequence
  Detection primer for PLAU
actccctcccctatcttaca

SEQ ID NO: 514 - DNA, 22 bp, Artificial Sequence
  Detection primer for VTN
gttatttgggttaatgtaggga

SEQ ID NO: 515 - DNA, 22 bp, Artificial Sequence
  Detection primer for VTN
tctatcccctcaaacttaaaaa

SEQ ID NO: 516 - DNA, 23 bp, Artificial Sequence
  Detection primer for SULT1A1
gaatttagggaaggagttagttg

SEQ ID NO: 517 - DNA, 22 bp, Artificial Sequence
  Detection primer for SULT1A1
atactaccaaacccactcaaac

SEQ ID NO: 518 - DNA, 22 bp, Artificial Sequence
  Detection primer for PCAF
ggataaatgattgagaggttgt

SEQ ID NO: 519 - DNA, 20 bp, Artificial Sequence
  Detection primer for PCAF
cctcccttaattctcctacc

SEQ ID NO: 520 - DNA, 27 bp, Artificial Sequence
  Detection primer for PRKCD
gatagaaggattttagtttttattgtt

SEQ ID NO: 521 - DNA, 18 bp, Artificial Sequence
  Detection primer for PRKCD
cttaacccatcccaatca

SEQ ID NO: 522 - DNA, 21 bp, Artificial Sequence
  Detection primer for ONECUT2
tttgttgggatttgttaggat

SEQ ID NO: 523 - DNA, 22 bp, Artificial Sequence
  Detection primer for ONECUT2
aaacattttacccctctaaacc

SEQ ID NO: 524 - DNA, 24 bp, Artificial Sequence
  Detection primer for BCL6
gggtaagaaagaaggaattagttt

SEQ ID NO: 525 - DNA, 21 bp, Artificial Sequence
  Detection primer for BCL6
catcaccacttctaaaaaccc

SEQ ID NO: 526 - DNA, 24 bp, Artificial Sequence
  Detection primer for WBP11
aagaggtgaggaagagtagtaaat

SEQ ID NO: 527 - DNA, 22 bp, Artificial Sequence
  Detection primer for WBP11
ctcccaacaactaaatcaaaat

SEQ ID NO: 528 - DNA, 19 bp, Artificial Sequence
  Detection primer for (MX1)
tgtaggagaggttgggaag

SEQ ID NO: 529 - DNA, 22 bp, Artificial Sequence
  Detection primer for (MX1)
ccaaacataacatccactaaaa

SEQ ID NO: 530 - DNA, 22 bp, Artificial Sequence
  Detection primer for N.N.
taggtttaagaggagagggaat

SEQ ID NO: 531 - DNA, 21 bp, Artificial Sequence
  Detection primer for N.N.
aaacaactacccaaatccaac

SEQ ID NO: 532 - DNA, 18 bp, Artificial Sequence
  Detection primer for APP
gagtaaggaagggggatg

SEQ ID NO: 533 - DNA, 23 bp, Artificial Sequence
  Detection primer for APP
aacccaaatctttaatacaaaaa

SEQ ID NO: 534 - DNA, 23 bp, Artificial Sequence
  Detection primer for NETO1
ggagtttttagaagaggaagatt

SEQ ID NO: 535 - DNA, 22 bp, Artificial Sequence
  Detection primer for NETO1
acttcacaataaataccctccc

SEQ ID NO: 536 - DNA, 22 bp, Artificial Sequence
  Detection primer for TBC1D3
ggtagaggaagtagttggtttg

SEQ ID NO: 537 - DNA, 23 bp, Artificial Sequence
  Detection primer for TBC1D3
cttttatatttctcccaatctcc

SEQ ID NO: 538 - DNA, 22 bp, Artificial Sequence
  Detection primer for GRB7
ttaggaagttttaggaatgagg

SEQ ID NO: 539 - DNA, 22 bp, Artificial Sequence
  Detection primer for GRB7
aaaatccataaccaccaaaata

SEQ ID NO: 540 - DNA, 21 bp, Artificial Sequence
  Detection primer for CYP2D6
atttgtagtttggggtgattt

SEQ ID NO: 541 - DNA, 22 bp, Artificial Sequence
  Detection primer for CYP2D6
aatttcctaacccactatcctc

SEQ ID NO: 542 - DNA, 22 bp, Artificial Sequence
  Detection primer for CDK6
gtgtaatgattttggattgaga

SEQ ID NO: 543 - DNA, 21 bp, Artificial Sequence
  Detection primer for CDK6
accttaaacaccttcccataa

SEQ ID NO: 544 - DNA, 21 bp, Artificial Sequence
  Detection primer for (Chr. 1p13.2)
aaggaaggtagagggttgagt

SEQ ID NO: 545 - DNA, 22 bp, Artificial Sequence
  Detection primer for (Chr. 1p13.2)
aaaatccaaaattaacaccatt

SEQ ID NO: 546 - DNA, 22 bp, Artificial Sequence
  Detection primer for (Chr. 17q25.1)
agtagatgaagttggggattag

SEQ ID NO: 547 - DNA, 22 bp, Artificial Sequence
  Detection primer for (Chr. 17q25.1)
tcctactatcccttctcaaaaa

SEQ ID NO: 548 - DNA, 24 bp, Artificial Sequence
  Detection primer for ABCA8
tgattgtgtagattatttttggtt

SEQ ID NO: 549 - DNA, 23 bp, Artificial Sequence
  Detection primer for ABCA8
caaactctctaaacctcaatctc

SEQ ID NO: 550 - DNA, 22 bp, Artificial Sequence
  Detection primer for (Chr. 12q14.3)
gatgaaagtggaaagattatgg

SEQ ID NO: 551 - DNA, 23 bp, Artificial Sequence
  Detection primer for (Chr. 12q14.3)
accctaacattctctaaacaaca

SEQ ID NO: 552 - DNA, 22 bp, Artificial Sequence
  Detection primer for (Chr. 8q12.1)
atttgaaggttgtgtttgtaga

SEQ ID NO: 553 - DNA, 19 bp, Artificial Sequence
  Detection primer for (Chr. 8q12.1)
ctccaactctcctcacctc

SEQ ID NO: 554 - DNA, 22 bp, Artificial Sequence
  Detection primer for MARK2
taaagtaggaaggtttggtttg

SEQ ID NO: 555 - DNA, 22 bp, Artificial Sequence
  Detection primer for MARK2
tcaccactatcctcaataatca

SEQ ID NO: 556 - DNA, 24 bp, Artificial Sequence
  Detection primer for ELK1
ttagaagtgaaagtagaagggttt

SEQ ID NO: 557 - DNA, 22 bp, Artificial Sequence
  Detection primer for ELK1
cctctaattcctatcaatcacc

SEQ ID NO: 558 - DNA, 22 bp, Artificial Sequence
  Detection primer for Q8WUT3
ggttagaagttagaggggtagg

SEQ ID NO: 559 - DNA, 22 bp, Artificial Sequence
  Detection primer for Q8WUT3
ccatcccattacctataaaaat

SEQ ID NO: 560 - DNA, 22 bp, Artificial Sequence
  Detection primer for CGB
tttgttttaggtggtgtgtaat

SEQ ID NO: 561 - DNA, 20 bp, Artificial Sequence
  Detection primer for CGB
tccaccctattttctaccaa

SEQ ID NO: 562 - DNA, 22 bp, Artificial Sequence
  Detection primer for BSG
ggagtaggtgaggagtattttg

SEQ ID NO: 563 - DNA, 22 bp, Artificial Sequence
  Detection primer for BSG
ttatctatccccacaccctaat

SEQ ID NO: 564 - DNA, 22 bp, Artificial Sequence
  Detection primer for BCKDK
tttgggagagttttaggattta

SEQ ID NO: 565 - DNA, 21 bp, Artificial Sequence
  Detection primer for BCKDK
tcacctccttttacaaccaat

SEQ ID NO: 566 - DNA, 20 bp, Artificial Sequence
  Detection primer for SOX8
gggtgggtagtaggtttgtt

SEQ ID NO: 567 - DNA, 22 bp, Artificial Sequence
  Detection primer for SOX8
acacactccttaaaactcttcc

SEQ ID NO: 568 - DNA, 23 bp, Artificial Sequence
  Detection primer for DAG1
tttggttatgtggagtttattgt

SEQ ID NO: 569 - DNA, 22 bp, Artificial Sequence
  Detection primer for DAG1
aataccaacccaaacatctacc

SEQ ID NO: 570 - DNA, 19 bp, Artificial Sequence
  Detection primer for ORC4L
ggtaatggtgggggtaaat

SEQ ID NO: 571 - DNA, 22 bp, Artificial Sequence
  Detection primer for ORC4L
cactcaaaacttccctacctac

SEQ ID NO: 572 - DNA, 21 bp, Artificial Sequence
  Detection primer for SEMA4B
gggtagagggaggttattgtt

SEQ ID NO: 573 - DNA, 22 bp, Artificial Sequence
  Detection primer for SEMA4B
accaaaatactactcccaaatc

SEQ ID NO: 574 - DNA, 22 bp, Artificial Sequence
  Detection primer for ESR1 (exon8)
tatgatttgttgttggagatgt

SEQ ID NO: 575 - DNA, 24 bp, Artificial Sequence
  Detection primer for ESR1 (exon8)
cttaaaatccctttaactattccc

SEQ ID NO: 576 - DNA, 16 bp, Artificial Sequence
  Detection oligonucleotide for (MX1)
aacgcgcgaaagtaaa

SEQ ID NO: 577 - DNA, 16 bp, Artificial Sequence
  Detection oligonucleotide for (MX1)
ttgggaatgtgtgaaa

SEQ ID NO: 578 - DNA, 17 bp, Artificial Sequence
  Detection oligonucleotide for (MX1)
ttcgagttgggtcgaga

SEQ ID NO: 579 - DNA, 17 bp, Artificial Sequence
  Detection oligonucleotide for (MX1)
tttgagttgggttgaga

SEQ ID NO: 580 - DNA, 16 bp, Artificial Sequence
  Detection oligonucleotide for (MX1)
tatgcgcgggaagatt

SEQ ID NO: 581 - DNA, 16 bp, Artificial Sequence
  Detection oligonucleotide for (MX1)
gtatgtgtgggaagat

SEQ ID NO: 582 - DNA, 16 bp, Artificial Sequence
  Detection oligonucleotide for (MX1)
atttacggttgcgcgg

SEQ ID NO: 583 - DNA, 17 bp, Artificial Sequence
  Detection oligonucleotide for (MX1)
tatggttgtgtgggtta

SEQ ID NO: 584 - DNA, 17 bp, Artificial Sequence
  Detection oligonucleotide for N.N.
aggcgtttatagtcggt

SEQ ID NO: 585 - DNA, 17 bp, Artificial Sequence
  Detection oligonucleotide for N.N.
aggtgtttatagttggt

SEQ ID NO: 586 - DNA, 16 bp, Artificial Sequence
  Detection oligonucleotide for N.N.
tttcgagttcggagta

SEQ ID NO: 587 - DNA, 17 bp, Artificial Sequence
  Detection oligonucleotide for N.N.
ttttgagtttggagtag

SEQ ID NO: 588 - DNA, 16 bp, Artificial Sequence
  Detection oligonucleotide for N.N.
ttgtcggtcgtagcgg

SEQ ID NO: 589 - DNA, 17 bp, Artificial Sequence
  Detection oligonucleotide for N.N.
tttgttggttgtagtgg

SEQ ID NO: 590 - DNA, 16 bp, Artificial Sequence
  Detection oligonucleotide for N.N.
ttcgttacggcggtag

SEQ ID NO: 591 - DNA, 16 bp, Artificial Sequence
  Detection oligonucleotide for N.N.
agtttgttatggtggt

SEQ ID NO: 592 - DNA, 16 bp, Artificial Sequence
  Detection oligonucleotide for APP
tgaaacgaggcggaga

SEQ ID NO: 593 - DNA, 16 bp, Artificial Sequence
  Detection oligonucleotide for APP
tgaaatgaggtggaga

SEQ ID NO: 594 - DNA, 16 bp, Artificial Sequence
  Detection oligonucleotide for APP
gacgttgcgttttcgg

SEQ ID NO: 595 - DNA, 17 bp, Artificial Sequence
  Detection oligonucleotide for APP
ggatgttgtgtttttgg

SEQ ID NO: 596 - DNA, 16 bp, Artificial Sequence
  Detection oligonucleotide for APP
tttttagcgggtcgga

SEQ ID NO: 597 - DNA, 16 bp, Artificial Sequence
  Detection oligonucleotide for APP
tttttagtgggttgga

SEQ ID NO: 598 - DNA, 16 bp, Artificial Sequence
  Detection oligonucleotide for APP
ggacgttcgtaagcgg

SEQ ID NO: 599 - DNA, 16 bp, Artificial Sequence
  Detection oligonucleotide for APP
ggatgtttgtaagtgg

SEQ ID NO: 600 - DNA, 17 bp, Artificial Sequence
  Detection oligonucleotide for ORC4L
ttatacgcgttgtttat

SEQ ID NO: 601 - DNA, 19 bp, Artificial Sequence
  Detection oligonucleotide for ORC4L
tgtattatatgtgttgttt

SEQ ID NO: 602 - DNA, 16 bp, Artificial Sequence
  Detection oligonucleotide for ORC4L
agcgtgacggttcgag

SEQ ID NO: 603 - DNA, 16 bp, Artificial Sequence
  Detection oligonucleotide for ORC4L
agtgtgatggtttgag

SEQ ID NO: 604 - DNA, 16 bp, Artificial Sequence
  Detection oligonucleotide for ORC4L
attaggcgagtttcgt

SEQ ID NO: 605 - DNA, 17 bp, Artificial Sequence
  Detection oligonucleotide for ORC4L
ttaggtgagttttgttt

SEQ ID NO: 606 - DNA, 17 bp, Artificial Sequence
  Detection oligonucleotide for NETO1
tacgttcggttttacga

SEQ ID NO: 607 - DNA, 19 bp, Artificial Sequence
  Detection oligonucleotide for NETO1
ttatgtttggttttatgat

SEQ ID NO: 608 - DNA, 16 bp, Artificial Sequence
  Detection oligonucleotide for NETO1
ttacgtcggtttcgat

SEQ ID NO: 609 - DNA, 18 bp, Artificial Sequence
  Detection oligonucleotide for NETO1
tttatgttggttttgatt

SEQ ID NO: 610 - DNA, 16 bp, Artificial Sequence
  Detection oligonucleotide for NETO1
ttcggtttcgggaaag

SEQ ID NO: 611 - DNA, 17 bp, Artificial Sequence
  Detection oligonucleotide for NETO1
tttggttttgggaaagg

SEQ ID NO: 612 - DNA, 16 bp, Artificial Sequence
  Detection oligonucleotide for NETO1
tgtcgtacgtgtttat

SEQ ID NO: 613 - DNA, 18 bp, Artificial Sequence
  Detection oligonucleotide for NETO1
aatttttgttgtatgtgt

SEQ ID NO: 614 - DNA, 16 bp, Artificial Sequence
  Detection oligonucleotide for (Chr. 17q25.1)
ttaggtcgggaggaaa

SEQ ID NO: 615 - DNA, 16 bp, Artificial Sequence
  Detection oligonucleotide for (Chr. 17q25.1)
ttaggttgggaggaaa

SEQ ID NO: 616 - DNA, 16 bp, Artificial Sequence
  Detection oligonucleotide for (Chr. 17q25.1)
ttagacgtggggcgat

SEQ ID NO: 617 - DNA, 16 bp, Artificial Sequence
  Detection oligonucleotide for (Chr. 17q25.1)
ttagatgtggggtgat

SEQ ID NO: 618 - DNA, 16 bp, Artificial Sequence
  Detection oligonucleotide for (Chr. 17q25.1)
taaggtacgagcgtgt

SEQ ID NO: 619 - DNA, 16 bp, Artificial Sequence
  Detection oligonucleotide for (Chr. 17q25.1)
aaggtatgagtgtgtg

SEQ ID NO: 620 - DNA, 17 bp, Artificial Sequence
  Detection oligonucleotide for (Chr. 17q25.1)
gtagagtacgagagatt

SEQ ID NO: 621 - DNA, 17 bp, Artificial Sequence
  Detection oligonucleotide for (Chr. 17q25.1)
ggtagagtatgagagat

SEQ ID NO: 622 - DNA, 17 bp, Artificial Sequence
  Detection oligonucleotide for (Chr. 12q14.3)
atgacgatgattggcga

SEQ ID NO: 623 - DNA, 17 bp, Artificial Sequence
  Detection oligonucleotide for (Chr. 12q14.3)
gatgatgattggtgagt

SEQ ID NO: 624 - DNA, 17 bp, Artificial Sequence
  Detection oligonucleotide for (Chr. 12q14.3)
ttatgacgtttaatcgt

SEQ ID NO: 625 - DNA, 19 bp, Artificial Sequence
  Detection oligonucleotide for (Chr. 12q14.3)
agttatgatgtttaattgt

SEQ ID NO: 626 - DNA, 16 bp, Artificial Sequence
  Detection oligonucleotide for (Chr. 12q14.3)
aatcgaacgttggcgt

SEQ ID NO: 627 - DNA, 17 bp, Artificial Sequence
  Detection oligonucleotide for (Chr. 12q14.3)
aaattgaatgttggtgt

SEQ ID NO: 628 - DNA, 16 bp, Artificial Sequence
  Detection oligonucleotide for MARK2
atatttcgggggaagt

SEQ ID NO: 629 - DNA, 17 bp, Artificial Sequence
  Detection oligonucleotide for MARK2
tatattttgggggaagt

SEQ ID NO: 630 - DNA, 16 bp, Artificial Sequence
  Detection oligonucleotide for MARK2
tttcgtatttgtcgga

SEQ ID NO: 631 - DNA, 17 bp, Artificial Sequence
  Detection oligonucleotide for MARK2
tttgtatttgttggagt

SEQ ID NO: 632 - DNA, 17 bp, Artificial Sequence
  Detection oligonucleotide for MARK2
ggttatatcgtagggta

SEQ ID NO: 633 - DNA, 17 bp, Artificial Sequence
  Detection oligonucleotide for MARK2
gggttatattgtagggt

SEQ ID NO: 634 - DNA, 16 bp, Artificial Sequence
  Detection oligonucleotide for MARK2
agggggacgaattagg

SEQ ID NO: 635 - DNA, 16 bp, Artificial Sequence
  Detection oligonucleotide for MARK2
gagggggatgaattag

SEQ ID NO: 636 - DNA, 16 bp, Artificial Sequence
  Detection oligonucleotide for Q8WUT3
tagaacggcgtgggat

SEQ ID NO: 637 - DNA, 16 bp, Artificial Sequence
  Detection oligonucleotide for Q8WUT3
tagaatggtgtgggat

SEQ ID NO: 638 - DNA, 18 bp, Artificial Sequence
  Detection oligonucleotide for Q8WUT3
gtcgcgatgtagttacgt

SEQ ID NO: 639 - DNA, 18 bp, Artificial Sequence
  Detection oligonucleotide for Q8WUT3
gttgtgatgtagttatgt

SEQ ID NO: 640 - DNA, 16 bp, Artificial Sequence
  Detection oligonucleotide for Q8WUT3
ttagtttcgggatcgg

SEQ ID NO: 641 - DNA, 17 bp, Artificial Sequence
  Detection oligonucleotide for Q8WUT3
tttagttttgggattgg

SEQ ID NO: 642 - DNA, 16 bp, Artificial Sequence
  Detection oligonucleotide for Q8WUT3
ttcgtttttcgggata

SEQ ID NO: 643 - DNA, 18 bp, Artificial Sequence
  Detection oligonucleotide for Q8WUT3
tttgttttttgggataaa

SEQ ID NO: 644 - DNA, 16 bp, Artificial Sequence
  Detection oligonucleotide for BSG
tacggttcgcgttgtt

SEQ ID NO: 645 - DNA, 16 bp, Artificial Sequence
  Detection oligonucleotide for BSG
ggagtatggtttgtgt

SEQ ID NO: 646 - DNA, 16 bp, Artificial Sequence
  Detection oligonucleotide for BSG
gtaaggttcggcgaga

SEQ ID NO: 647 - DNA, 16 bp, Artificial Sequence
  Detection oligonucleotide for BSG
gtaaggtttggtgaga

SEQ ID NO: 648 - DNA, 16 bp, Artificial Sequence
  Detection oligonucleotide for BSG
ttacgttttcgggaag

SEQ ID NO: 649 - DNA, 17 bp, Artificial Sequence
  Detection oligonucleotide for BSG
ttatgtttttgggaagg

SEQ ID NO: 650 - DNA, 17 bp, Artificial Sequence
  Detection oligonucleotide for BSG
tacgtttcgaggatcgg

SEQ ID NO: 651 - DNA, 17 bp, Artificial Sequence
  Detection oligonucleotide for BSG
tatgttttgaggattgg

SEQ ID NO: 652 - DNA, 16 bp, Artificial Sequence
  Detection oligonucleotide for BCKDK
gggcgttaggcggatt

SEQ ID NO: 653 - DNA, 16 bp, Artificial Sequence
  Detection oligonucleotide for BCKDK
tgggtgttaggtggat

SEQ ID NO: 654 - DNA, 16 bp, Artificial Sequence
  Detection oligonucleotide for BCKDK
agagcggttagcgtag

SEQ ID NO: 655 - DNA, 16 bp, Artificial Sequence
  Detection oligonucleotide for BCKDK
tgagagtggttagtgt

SEQ ID NO: 656 - DNA, 16 bp, Artificial Sequence
  Detection oligonucleotide for BCKDK
atagagggcgtgaatt

SEQ ID NO: 657 - DNA, 16 bp, Artificial Sequence
  Detection oligonucleotide for BCKDK
agagggtgtgaatttt

SEQ ID NO: 658 - DNA, 17 bp, Artificial Sequence
  Detection oligonucleotide for BCKDK
taggatttacgaggaaa

SEQ ID NO: 659 - DNA, 18 bp, Artificial Sequence
  Detection oligonucleotide for BCKDK
aggatttatgaggaaaat

SEQ ID NO: 660 - DNA, 16 bp, Artificial Sequence
  Detection oligonucleotide for SOX8
ttttcggttcgaagta

SEQ ID NO: 661 - DNA, 17 bp, Artificial Sequence
  Detection oligonucleotide for SOX8
ttttggtttgaagtagg

SEQ ID NO: 662 - DNA, 16 bp, Artificial Sequence
  Detection oligonucleotide for SOX8
aggtcgtttttatcga

SEQ ID NO: 663 - DNA, 18 bp, Artificial Sequence
  Detection oligonucleotide for SOX8
aggttgtttttattgagt

SEQ ID NO: 664 - DNA, 16 bp, Artificial Sequence
  Detection oligonucleotide for SOX8
gtagttacggggcgtt

SEQ ID NO: 665 - DNA, 16 bp, Artificial Sequence
  Detection oligonucleotide for SOX8
gtagttatggggtgtt

SEQ ID NO: 666 - DNA, 16 bp, Artificial Sequence
  Detection oligonucleotide for SOX8
tgtcgtataggcggtt

SEQ ID NO: 667 - DNA, 17 bp, Artificial Sequence
  Detection oligonucleotide for SOX8
ttgttgtataggtggtt

SEQ ID NO: 668 - DNA, 17 bp, Artificial Sequence
  Detection oligonucleotide for SEMA4B
agttttgggcgcgattt

SEQ ID NO: 669 - DNA, 17 bp, Artificial Sequence
  Detection oligonucleotide for SEMA4B
agttttgggtgtgattt

SEQ ID NO: 670 - DNA, 18 bp, Artificial Sequence
  Detection oligonucleotide for SEMA4B
agcgaatagattgcggat

SEQ ID NO: 671 - DNA, 18 bp, Artificial Sequence
  Detection oligonucleotide for SEMA4B
agtgaatagattgtggat

SEQ ID NO: 672 - DNA, 18 bp, Artificial Sequence
  Detection oligonucleotide for SEMA4B
agcgattagattgcggat

SEQ ID NO: 673 - DNA, 18 bp, Artificial Sequence
  Detection oligonucleotide for SEMA4B
agtgattagattgtggat

SEQ ID NO: 674 - DNA, 16 bp, Artificial Sequence
  Detection oligonucleotide for SEMA4B
taggcgttcgattttt

SEQ ID NO: 675 - DNA, 16 bp, Artificial Sequence
  Detection oligonucleotide for SEMA4B
gggtaggtgtttgatt

SEQ ID NO: 676 - DNA, 17 bp, Artificial Sequence
  Detection oligonucleotide for CDKN2A
ggcgttgtttaacgtat

SEQ ID NO: 677 - DNA, 17 bp, Artificial Sequence
  Detection oligonucleotide for CDKN2A
gggtgttgtttaatgta

SEQ ID NO: 678 - DNA, 20 bp, Artificial Sequence
  Detection oligonucleotide for CDKN2A
aacgtatcgaatagttacgg

SEQ ID NO: 679 - DNA, 20 bp, Artificial Sequence
  Detection oligonucleotide for CDKN2A
aatgtattgaatagttatgg

SEQ ID NO: 680 - DNA, 16 bp, Artificial Sequence
  Detection oligonucleotide for CDKN2A
tacggtcggaggtcga

SEQ ID NO: 681 - DNA, 16 bp, Artificial Sequence
  Detection oligonucleotide for CDKN2A
tatggttggaggttga

SEQ ID NO: 682 - DNA, 18 bp, Artificial Sequence
  Detection oligonucleotide for CA9
atggtttcgataattttt

SEQ ID NO: 683 - DNA, 19 bp, Artificial Sequence
  Detection oligonucleotide for CA9
atggttttgataatttttt

SEQ ID NO: 684 - DNA, 17 bp, Artificial Sequence
  Detection oligonucleotide for CA9
tgtacgtatagttcgta

SEQ ID NO: 685 - DNA, 20 bp, Artificial Sequence
  Detection oligonucleotide for CA9
ttaatgtatgtatagtttgt

SEQ ID NO: 686 - DNA, 17 bp, Artificial Sequence
  Detection oligonucleotide for CA9
atatatcgtgtgttggg

SEQ ID NO: 687 - DNA, 17 bp, Artificial Sequence
  Detection oligonucleotide for CA9
atatattgtgtgttggg

SEQ ID NO: 688 - DNA, 17 bp, Artificial Sequence
  Detection oligonucleotide for CA9
atagttagtcgtatggt

SEQ ID NO: 689 - DNA, 18 bp, Artificial Sequence
  Detection oligonucleotide for CA9
atagttagttgtatggtt

SEQ ID NO: 690 - DNA, 18 bp, Artificial Sequence
  Detection oligonucleotide for PAX6
tattgtttcggttgttag

SEQ ID NO: 691 - DNA, 18 bp, Artificial Sequence
  Detection oligonucleotide for PAX6
tattgttttggttgttag

SEQ ID NO: 692 - DNA, 16 bp, Artificial Sequence
  Detection oligonucleotide for PAX6
ggcgacgcggttagtt

SEQ ID NO: 693 - DNA, 16 bp, Artificial Sequence
  Detection oligonucleotide for PAX6
ggtgatgtggttagtt

SEQ ID NO: 694 - DNA, 16 bp, Artificial Sequence
  Detection oligonucleotide for PAX6
taggtcgcgtagattt

SEQ ID NO: 695 - DNA, 17 bp, Artificial Sequence
  Detection oligonucleotide for PAX6
agtttaggttgtgtaga

SEQ ID NO: 696 - DNA, 16 bp, Artificial Sequence
  Detection oligonucleotide for PAX6
tagcgtatttttcggt

SEQ ID NO: 697 - DNA, 18 bp, Artificial Sequence
  Detection oligonucleotide for PAX6
tagtgtattttttggttg

SEQ ID NO: 698 - DNA, 16 bp, Artificial Sequence
  Detection oligonucleotide for SFN
agtaggtcgaacgtta

SEQ ID NO: 699 - DNA, 17 bp, Artificial Sequence
  Detection oligonucleotide for SFN
agagtaggttgaatgtt

SEQ ID NO: 700 - DNA, 16 bp, Artificial Sequence
  Detection oligonucleotide for SFN
ttgcgaagagcgaaat

SEQ ID NO: 701 - DNA, 17 bp, Artificial Sequence
  Detection oligonucleotide for SFN
tgtgaagagtgaaattt

SEQ ID NO: 702 - DNA, 16 bp, Artificial Sequence
  Detection oligonucleotide for SFN
ttcgaggtgcgtgagt

SEQ ID NO: 703 - DNA, 17 bp, Artificial Sequence
  Detection oligonucleotide for SFN
tttgaggtgtgtgagta

SEQ ID NO: 704 - DNA, 16 bp, Artificial Sequence
  Detection oligonucleotide for SFN
tgtgcgatatcgtgtt

SEQ ID NO: 705 - DNA, 17 bp, Artificial Sequence
  Detection oligonucleotide for SFN
tgtgatattgtgttggg

SEQ ID NO: 706 - DNA, 16 bp, Artificial Sequence
  Detection oligonucleotide for TP73
ttcgttcgcgaagtta

SEQ ID NO: 707 - DNA, 18 bp, Artificial Sequence
  Detection oligonucleotide for TP73
ggtttgtttgtgaagtta

SEQ ID NO: 708 - DNA, 16 bp, Artificial Sequence
  Detection oligonucleotide for PLAU
aagaggtcgtcgggat

SEQ ID NO: 709 - DNA, 16 bp, Artificial Sequence
  Detection oligonucleotide for PLAU
aagaggttgttgggat

SEQ ID NO: 710 - DNA, 16 bp, Artificial Sequence
  Detection oligonucleotide for PLAU
ttatcgcgggtatttt

SEQ ID NO: 711 - DNA, 17 bp, Artificial Sequence
  Detection oligonucleotide for PLAU
ttggttattgtgggtat

SEQ ID NO: 712 - DNA, 18 bp, Artificial Sequence
  Detection oligonucleotide for PLAU
ttcgatttcgttattatg

SEQ ID NO: 713 - DNA, 20 bp, Artificial Sequence
  Detection oligonucleotide for PLAU
tttgattttgttattatgag

SEQ ID NO: 714 - DNA, 16 bp, Artificial Sequence
  Detection oligonucleotide for PLAU
gtcgtgagcgatttta

SEQ ID NO: 715 - DNA, 16 bp, Artificial Sequence
  Detection oligonucleotide for PLAU
ttggttgtgagtgatt

SEQ ID NO: 716 - DNA, 18 bp, Artificial Sequence
  Detection oligonucleotide for GRIN2D
atttcgatttggaggcgg

SEQ ID NO: 717 - DNA, 18 bp, Artificial Sequence
  Detection oligonucleotide for GRIN2D
attttgatttggaggtgg

SEQ ID NO: 718 - DNA, 16 bp, Artificial Sequence
  Detection oligonucleotide for PSAT1
ttcgtcggtgttacgt

SEQ ID NO: 719 - DNA, 17 bp, Artificial Sequence
  Detection oligonucleotide for PSAT1
ttttgttggtgttatgt

SEQ ID NO: 720 - DNA, 16 bp, Artificial Sequence
  Detection oligonucleotide for PSAT1
ggcgagttcgggtagt

SEQ ID NO: 721 - DNA, 16 bp, Artificial Sequence
  Detection oligonucleotide for PSAT1
ggtgagtttgggtagt

SEQ ID NO: 722 - DNA, 16 bp, Artificial Sequence
  Detection oligonucleotide for PSAT1
aagttttcgcgagcgg

SEQ ID NO: 723 - DNA, 16 bp, Artificial Sequence
  Detection oligonucleotide for PSAT1
aagtttttgtgagtgg

SEQ ID NO: 724 - DNA, 16 bp, Artificial Sequence
  Detection oligonucleotide for PSAT1
aggaagttcggcgagg

SEQ ID NO: 725 - DNA, 16 bp, Artificial Sequence
  Detection oligonucleotide for PSAT1
aggaagtttggtgagg

SEQ ID NO: 726 - DNA, 16 bp, Artificial Sequence
  Detection oligonucleotide for CYP2D6
tacgacgattttcgtt

SEQ ID NO: 727 - DNA, 18 bp, Artificial Sequence
  Detection oligonucleotide for CYP2D6
gagtatgatgatttttgt

SEQ ID NO: 728 - DNA, 17 bp, Artificial Sequence
  Detection oligonucleotide for CYP2D6
ttcgtcgattaagtcgg

SEQ ID NO: 729 - DNA, 18 bp, Artificial Sequence
  Detection oligonucleotide for CYP2D6
tttgttgattaagttggt

SEQ ID NO: 730 - DNA, 16 bp, Artificial Sequence
  Detection oligonucleotide for CYP2D6
gtggcgcgagtagagg

SEQ ID NO: 731 - DNA, 16 bp, Artificial Sequence
  Detection oligonucleotide for CYP2D6
gtggtgtgagtagagg

SEQ ID NO: 732 - DNA, 17 bp, Artificial Sequence
  Detection oligonucleotide for CYP2D6
aacgtttacgtgttcgt

SEQ ID NO: 733 - DNA, 19 bp, Artificial Sequence
  Detection oligonucleotide for CYP2D6
gtaatgtttatgtgtttgt

SEQ ID NO: 734 - DNA, 16 bp, Artificial Sequence
  Detection oligonucleotide for SULT1A1
ttcgagtcgttttgat

SEQ ID NO: 735 - DNA, 17 bp, Artificial Sequence
  Detection oligonucleotide for SULT1A1
tttgagttgttttgatg

SEQ ID NO: 736 - DNA, 16 bp, Artificial Sequence
  Detection oligonucleotide for SULT1A1
ttcgtcgtgtacggtt

SEQ ID NO: 737 - DNA, 17 bp, Artificial Sequence
  Detection oligonucleotide for SULT1A1
tttgttgtgtatggttt

SEQ ID NO: 738 - DNA, 16 bp, Artificial Sequence
  Detection oligonucleotide for SULT1A1
aggatttcgttttcgg

SEQ ID NO: 739 - DNA, 17 bp, Artificial Sequence
  Detection oligonucleotide for SULT1A1
aggattttgtttttggg

SEQ ID NO: 740 - DNA, 17 bp, Artificial Sequence
  Detection oligonucleotide for SULT1A1
ttttcggttgaagtcgg

SEQ ID NO: 741 - DNA, 17 bp, Artificial Sequence
  Detection oligonucleotide for SULT1A1
tttttggttgaagttgg

SEQ ID NO: 742 - DNA, 16 bp, Artificial Sequence
  Detection oligonucleotide for PRKCD
atttcgcgttcggatt

SEQ ID NO: 743 - DNA, 17 bp, Artificial Sequence
  Detection oligonucleotide for PRKCD
gattttgtgtttggatt

SEQ ID NO: 744 - DNA, 16 bp, Artificial Sequence
  Detection oligonucleotide for EGR4
aagcgtatttatcgga

SEQ ID NO: 745 - DNA, 18 bp, Artificial Sequence
  Detection oligonucleotide for EGR4
ggaagtgtatttattgga

SEQ ID NO: 746 - DNA, 16 bp, Artificial Sequence
  Detection oligonucleotide for EGR4
tatcggacggtcggtt

SEQ ID NO: 747 - DNA, 17 bp, Artificial Sequence
  Detection oligonucleotide for EGR4
atttattggatggttgg

SEQ ID NO: 748 - DNA, 16 bp, Artificial Sequence
  Detection oligonucleotide for EGR4
aggcgtagcgttttag

SEQ ID NO: 749 - DNA, 16 bp, Artificial Sequence
  Detection oligonucleotide for EGR4
tgaggtgtagtgtttt

SEQ ID NO: 750 - DNA, 17 bp, Artificial Sequence
  Detection oligonucleotide for EGR4
aacgttatagttcgagt

SEQ ID NO: 751 - DNA, 19 bp, Artificial Sequence
  Detection oligonucleotide for EGR4
aatgttatagtttgagttt

SEQ ID NO: 752 - DNA, 16 bp, Artificial Sequence
  Detection oligonucleotide for TP73
gtgcgagttagtcgga

SEQ ID NO: 753 - DNA, 16 bp, Artificial Sequence
  Detection oligonucleotide for TP73
gtgtgagttagttgga

SEQ ID NO: 754 - DNA, 16 bp, Artificial Sequence
  Detection oligonucleotide for TP73
tatcggttcggagtta

SEQ ID NO: 755 - DNA, 17 bp, Artificial Sequence
  Detection oligonucleotide for TP73
aggatattggtttggag

SEQ ID NO: 756 - DNA, 16 bp, Artificial Sequence
  Detection oligonucleotide for TP73
agagtcgttcggaatt

SEQ ID NO: 757 - DNA, 17 bp, Artificial Sequence
  Detection oligonucleotide for TP73
tgagagttgtttggaat

SEQ ID NO: 758 - DNA, 16 bp, Artificial Sequence
  Detection oligonucleotide for TES
tagaagtcggttcgtg

SEQ ID NO: 759 - DNA, 16 bp, Artificial Sequence
  Detection oligonucleotide for TES
agaagttggtttgtgg

SEQ ID NO: 760 - DNA, 16 bp, Artificial Sequence
  Detection oligonucleotide for TES
gattgggcggcggaag

SEQ ID NO: 761 - DNA, 16 bp, Artificial Sequence
  Detection oligonucleotide for TES
attgggtggtggaagt

SEQ ID NO: 762 - DNA, 16 bp, Artificial Sequence
  Detection oligonucleotide for TES
tagcggagtcggaggt

SEQ ID NO: 763 - DNA, 16 bp, Artificial Sequence
  Detection oligonucleotide for TES
tagtggagttggaggt

SEQ ID NO: 764 - DNA, 16 bp, Artificial Sequence
  Detection oligonucleotide for TES
aattcggtcgtgggat

SEQ ID NO: 765 - DNA, 16 bp, Artificial Sequence
  Detection oligonucleotide for TES
aatttggttgtgggat

SEQ ID NO: 766 - DNA, 16 bp, Artificial Sequence
  Detection oligonucleotide for GRIN2D
gagagtcgggatgatt

SEQ ID NO: 767 - DNA, 16 bp, Artificial Sequence
  Detection oligonucleotide for GRIN2D
ggagagttgggatgat

SEQ ID NO: 768 - DNA, 16 bp, Artificial Sequence
  Detection oligonucleotide for GRIN2D
tagggtcgagatttgg

SEQ ID NO: 769 - DNA, 17 bp, Artificial Sequence
  Detection oligonucleotide for GRIN2D
ttagggttgagatttgg

SEQ ID NO: 770 - DNA, 16 bp, Artificial Sequence
  Detection oligonucleotide for GRIN2D
agtgtggcgaatattg

SEQ ID NO: 771 - DNA, 17 bp, Artificial Sequence
  Detection oligonucleotide for GRIN2D
gtgtggtgaatattgaa

SEQ ID NO: 772 - DNA, 19 bp, Artificial Sequence
  Detection oligonucleotide for PRKCD
atttatttttcgttgtagg

SEQ ID NO: 773 - DNA, 20 bp, Artificial Sequence
  Detection oligonucleotide for PRKCD
tatttattttttgttgtagg

SEQ ID NO: 774 - DNA, 16 bp, Artificial Sequence
  Detection oligonucleotide for PRKCD
tttcggaaacgggaat

SEQ ID NO: 775 - DNA, 17 bp, Artificial Sequence
  Detection oligonucleotide for PRKCD
tagttttggaaatggga

SEQ ID NO: 776 - DNA, 16 bp, Artificial Sequence
  Detection oligonucleotide for PRKCD
ggacggagttatcggt

SEQ ID NO: 777 - DNA, 17 bp, Artificial Sequence
  Detection oligonucleotide for PRKCD
ggatggagttattggta

SEQ ID NO: 778 - DNA, 16 bp, Artificial Sequence
  Detection oligonucleotide for PRKCD
gtttagcggagggata

SEQ ID NO: 779 - DNA, 16 bp, Artificial Sequence
  Detection oligonucleotide for PRKCD
tgtttagtggagggat

SEQ ID NO: 780 - DNA, 17 bp, Artificial Sequence
  Detection oligonucleotide for ESR1 (exon8)
ttgttacggtttgagag

SEQ ID NO: 781 - DNA, 18 bp, Artificial Sequence
  Detection oligonucleotide for ESR1 (exon8)
ttgttatggtttgagagt

SEQ ID NO: 782 - DNA, 19 bp, Artificial Sequence
  Detection oligonucleotide for ESR1 (exon8)
tttgttatagtttgagagt

SEQ ID NO: 783 - DNA, 16 bp, Artificial Sequence
  Detection oligonucleotide for ESR1 (exon8)
tttgttacggtttgag

SEQ ID NO: 784 - DNA, 17 bp, Artificial Sequence
  Detection oligonucleotide for ESR1 (exon8)
tttgttatggtttgaga

SEQ ID NO: 785 - DNA, 18 bp, Artificial Sequence
  Detection oligonucleotide for ESR1 (exon8)
tttgttatagtttgagag

SEQ ID NO: 786 - DNA, 18 bp, Artificial Sequence
  Detection oligonucleotide for S100A2
tttaattgcggttgtgtg

SEQ ID NO: 787 - DNA, 18 bp, Artificial Sequence
  Detection oligonucleotide for S100A2
tttaattgtggttgtgtg

SEQ ID NO: 788 - DNA, 18 bp, Artificial Sequence
  Detection oligonucleotide for S100A2
tatataggcgtatgtatg

SEQ ID NO: 789 - DNA, 18 bp, Artificial Sequence
  Detection oligonucleotide for S100A2
tatataggtgtatgtatg

SEQ ID NO: 790 - DNA, 17 bp, Artificial Sequence
  Detection oligonucleotide for S100A2
tgtatacgagtattgga

SEQ ID NO: 791 - DNA, 19 bp, Artificial Sequence
  Detection oligonucleotide for S100A2
tatgtatatgagtattgga

SEQ ID NO: 792 - DNA, 18 bp, Artificial Sequence
  Detection oligonucleotide for S100A2
agttttagcgtgtgttta

SEQ ID NO: 793 - DNA, 18 bp, Artificial Sequence
  Detection oligonucleotide for S100A2
agttttagtgtgtgttta

SEQ ID NO: 794 - DNA, 20 bp, Artificial Sequence
  Detection oligonucleotide for TFF1
agaatttatcgtataaaaag

SEQ ID NO: 795 - DNA, 20 bp, Artificial Sequence
  Detection oligonucleotide for TFF1
aatttattgtataaaaaggt

SEQ ID NO: 796 - DNA, 16 bp, Artificial Sequence
  Detection oligonucleotide for TFF1
ggacgtcgatggtatt

SEQ ID NO: 797 - DNA, 16 bp, Artificial Sequence
  Detection oligonucleotide for TFF1
agggatgttgatggta

SEQ ID NO: 798 - DNA, 16 bp, Artificial Sequence
  Detection oligonucleotide for TFF1
aacggtgtcgtcgaaa

SEQ ID NO: 799 - DNA, 17 bp, Artificial Sequence
  Detection oligonucleotide for TFF1
aatggtgttgttgaaat

SEQ ID NO: 800 - DNA, 16 bp, Artificial Sequence
  Detection oligonucleotide for ONECUT2
tacgtagttgcgcgtt

SEQ ID NO: 801 - DNA, 17 bp, Artificial Sequence
  Detection oligonucleotide for ONECUT2
gtatgtagttgtgtgtt

SEQ ID NO: 802 - DNA, 16 bp, Artificial Sequence
  Detection oligonucleotide for ONECUT2
ttttgtgcgtacggat

SEQ ID NO: 803 - DNA, 17 bp, Artificial Sequence
  Detection oligonucleotide for ONECUT2
tttttgtgtgtatggat

SEQ ID NO: 804 - DNA, 16 bp, Artificial Sequence
  Detection oligonucleotide for ONECUT2
ttaagcgggcgttgat

SEQ ID NO: 805 - DNA, 16 bp, Artificial Sequence
  Detection oligonucleotide for ONECUT2
ttaagtgggtgttgat

SEQ ID NO: 806 - DNA, 16 bp, Artificial Sequence
  Detection oligonucleotide for ONECUT2
tagaggcgcgggttat

SEQ ID NO: 807 - DNA, 16 bp, Artificial Sequence
  Detection oligonucleotide for ONECUT2
tagaggtgtgggttat

SEQ ID NO: 808 - DNA, 17 bp, Artificial Sequence
  Detection oligonucleotide for PSAT1
tttcgattcggtttaga

SEQ ID NO: 809 - DNA, 18 bp, Artificial Sequence
  Detection oligonucleotide for PSAT1
aattgttttgatttggtt

SEQ ID NO: 810 - DNA, 16 bp, Artificial Sequence
  Detection oligonucleotide for PSAT1
taatggggcgtcgatt

SEQ ID NO: 811 - DNA, 17 bp, Artificial Sequence
  Detection oligonucleotide for PSAT1
ttaatggggtgttgatt

SEQ ID NO: 812 - DNA, 16 bp, Artificial Sequence
  Detection oligonucleotide for PSAT1
tatcgtagcggttagg

SEQ ID NO: 813 - DNA, 18 bp, Artificial Sequence
  Detection oligonucleotide for PSAT1
tattgtagtggttaggaa

SEQ ID NO: 814 - DNA, 16 bp, Artificial Sequence
  Detection oligonucleotide for PSAT1
aggaacgttagtcgtt

SEQ ID NO: 815 - DNA, 18 bp, Artificial Sequence
  Detection oligonucleotide for PSAT1
taggaatgttagttgttt

SEQ ID NO: 816 - DNA, 17 bp, Artificial Sequence
  Detection oligonucleotide for PSAT1
ggtcgtcgtattatgga

SEQ ID NO: 817 - DNA, 18 bp, Artificial Sequence
  Detection oligonucleotide for PSAT1
tggttgttgtattatgga

SEQ ID NO: 818 - DNA, 16 bp, Artificial Sequence
  Detection oligonucleotide for PSAT1
atagtaaacgcgagga

SEQ ID NO: 819 - DNA, 16 bp, Artificial Sequence
  Detection oligonucleotide for PSAT1
agtaaatgtgaggagg

SEQ ID NO: 820 - DNA, 16 bp, Artificial Sequence
  Detection oligonucleotide for DAG1
tttcgtggcggagaat

SEQ ID NO: 821 - DNA, 16 bp, Artificial Sequence
  Detection oligonucleotide for DAG1
ttttgtggtggagaat

SEQ ID NO: 822 - DNA, 16 bp, Artificial Sequence
  Detection oligonucleotide for DAG1
tacggatatttcggtt

SEQ ID NO: 823 - DNA, 19 bp, Artificial Sequence
  Detection oligonucleotide for DAG1
aattatggatattttggtt

SEQ ID NO: 824 - DNA, 16 bp, Artificial Sequence
  Detection oligonucleotide for DAG1
ttacgattcgtaggtt

SEQ ID NO: 825 - DNA, 20 bp, Artificial Sequence
  Detection oligonucleotide for DAG1
tattattatgatttgtaggt

SEQ ID NO: 826 - DNA, 16 bp, Artificial Sequence
  Detection oligonucleotide for SYK
gaagttatcgcgttgg

SEQ ID NO: 827 - DNA, 17 bp, Artificial Sequence
  Detection oligonucleotide for SYK
agaagttattgtgttgg

SEQ ID NO: 828 - DNA, 16 bp, Artificial Sequence
  Detection oligonucleotide for SYK
gatcgatgcggtttat

SEQ ID NO: 829 - DNA, 17 bp, Artificial Sequence
  Detection oligonucleotide for SYK
gggattgatgtggttta

SEQ ID NO: 830 - DNA, 16 bp, Artificial Sequence
  Detection oligonucleotide for SYK
gttcggcgggaggaga

SEQ ID NO: 831 - DNA, 16 bp, Artificial Sequence
  Detection oligonucleotide for SYK
gtttggtgggaggaga

SEQ ID NO: 832 - DNA, 17 bp, Artificial Sequence
  Detection oligonucleotide for SYK
agtcgattttcgtttag

SEQ ID NO: 833 - DNA, 19 bp, Artificial Sequence
  Detection oligonucleotide for SYK
tagttgatttttgtttagt

SEQ ID NO: 834 - DNA, 16 bp, Artificial Sequence
  Detection oligonucleotide for SYK
ggaagagtcgcgggtt

SEQ ID NO: 835 - DNA, 16 bp, Artificial Sequence
  Detection oligonucleotide for SYK
ggaagagttgtgggtt

SEQ ID NO: 836 - DNA, 20 bp, Artificial Sequence
  Detection oligonucleotide for CGA
atatttattttcggaaattt

SEQ ID NO: 837 - DNA, 21 bp, Artificial Sequence
  Detection oligonucleotide for CGA
ttatttttggaaatttatagt

SEQ ID NO: 838 - DNA, 19 bp, Artificial Sequence
  Detection oligonucleotide for CGA
tgattttgtcgttattatt

SEQ ID NO: 839 - DNA, 20 bp, Artificial Sequence
  Detection oligonucleotide for CGA
ttgattttgttgttattatt

SEQ ID NO: 840 - DNA, 18 bp, Artificial Sequence
  Detection oligonucleotide for CGA
taaattgacgttatggta

SEQ ID NO: 841 - DNA, 19 bp, Artificial Sequence
  Detection oligonucleotide for CGA
aaattgatgttatggtaaa

SEQ ID NO: 842 - DNA, 18 bp, Artificial Sequence
  Detection oligonucleotide for CGA
aattgacgttatggtaat

SEQ ID NO: 843 - DNA, 19 bp, Artificial Sequence
  Detection oligonucleotide for CGA
taaaaattgatgttatggt

SEQ ID NO: 844 - DNA, 16 bp, Artificial Sequence
  Detection oligonucleotide for CYP2D6
gagatcgcgttttcgt

SEQ ID NO: 845 - DNA, 17 bp, Artificial Sequence
  Detection oligonucleotide for CYP2D6
agagattgtgtttttgt

SEQ ID NO: 846 - DNA, 16 bp, Artificial Sequence
  Detection oligonucleotide for CYP2D6
attcgcggcgaggata

SEQ ID NO: 847 - DNA, 16 bp, Artificial Sequence
  Detection oligonucleotide for CYP2D6
gatttgtggtgaggat

SEQ ID NO: 848 - DNA, 16 bp, Artificial Sequence
  Detection oligonucleotide for CYP2D6
gtcgtttcggggacgt

SEQ ID NO: 849 - DNA, 17 bp, Artificial Sequence
  Detection oligonucleotide for CYP2D6
gttgttttggggatgtg

SEQ ID NO: 850 - DNA, 16 bp, Artificial Sequence
  Detection oligonucleotide for CYP2D6
taagtagcgtcgatag

SEQ ID NO: 851 - DNA, 17 bp, Artificial Sequence
  Detection oligonucleotide for CYP2D6
aagtagtgttgataggg

SEQ ID NO: 852 - DNA, 17 bp, Artificial Sequence
  Detection oligonucleotide for RASSF1
agtaaatcggattagga

SEQ ID NO: 853 - DNA, 18 bp, Artificial Sequence
  Detection oligonucleotide for RASSF1
agtaaattggattaggag

SEQ ID NO: 854 - DNA, 17 bp, Artificial Sequence
  Detection oligonucleotide for RASSF1
tacgggtattttcgcgt

SEQ ID NO: 855 - DNA, 18 bp, Artificial Sequence
  Detection oligonucleotide for RASSF1
atatgggtatttttgtgt

SEQ ID NO: 856 - DNA, 16 bp, Artificial Sequence
  Detection oligonucleotide for RASSF1
tgcgagagcgcgttta

SEQ ID NO: 857 - DNA, 17 bp, Artificial Sequence
  Detection oligonucleotide for RASSF1
ttgtgagagtgtgttta

SEQ ID NO: 858 - DNA, 16 bp, Artificial Sequence
  Detection oligonucleotide for TP53
tattaggtcggcgaga

SEQ ID NO: 859 - DNA, 16 bp, Artificial Sequence
  Detection oligonucleotide for TP53
aggttggtgagaattt

SEQ ID NO: 860 - DNA, 16 bp, Artificial Sequence
  Detection oligonucleotide for TP53
ttcggtaggcggatta

SEQ ID NO: 861 - DNA, 16 bp, Artificial Sequence
  Detection oligonucleotide for TP53
tttttggtaggtggat

SEQ ID NO: 862 - DNA, 16 bp, Artificial Sequence
  Detection oligonucleotide for TP53
atattttgcgttcggg

SEQ ID NO: 863 - DNA, 17 bp, Artificial Sequence
  Detection oligonucleotide for TP53
atattttgtgtttgggt

SEQ ID NO: 864 - DNA, 16 bp, Artificial Sequence
  Detection oligonucleotide for TP53
tacgacggtgatacgt

SEQ ID NO: 865 - DNA, 18 bp, Artificial Sequence
  Detection oligonucleotide for TP53
tttatgatggtgatatgt

SEQ ID NO: 866 - DNA, 16 bp, Artificial Sequence
  Detection oligonucleotide for CDK6
tacgaatgcgtggcgg

SEQ ID NO: 867 - DNA, 17 bp, Artificial Sequence
  Detection oligonucleotide for CDK6
tatgaatgtgtggtgga

SEQ ID NO: 868 - DNA, 16 bp, Artificial Sequence
  Detection oligonucleotide for CDK6
tttcggagtaggcgag

SEQ ID NO: 869 - DNA, 16 bp, Artificial Sequence
  Detection oligonucleotide for CDK6
ttttggagtaggtgag

SEQ ID NO: 870 - DNA, 16 bp, Artificial Sequence
  Detection oligonucleotide for CDK6
tacgttagtttcgcgg

SEQ ID NO: 871 - DNA, 17 bp, Artificial Sequence
  Detection oligonucleotide for CDK6
tatgttagttttgtggg

SEQ ID NO: 872 - DNA, 16 bp, Artificial Sequence
  Detection oligonucleotide for CDK6
attgagacgcgtttgg

SEQ ID NO: 873 - DNA, 16 bp, Artificial Sequence
  Detection oligonucleotide for CDK6
gagatgtgtttgggta

SEQ ID NO: 874 - DNA, 17 bp, Artificial Sequence
  Detection oligonucleotide for TMEFF2
tatcgtagttcgttcgg

SEQ ID NO: 875 - DNA, 17 bp, Artificial Sequence
  Detection oligonucleotide for TMEFF2
attgtagtttgtttggt

SEQ ID NO: 876 - DNA, 16 bp, Artificial Sequence
  Detection oligonucleotide for TMEFF2
aaacgtttatcggttg

SEQ ID NO: 877 - DNA, 17 bp, Artificial Sequence
  Detection oligonucleotide for TMEFF2
aatgtttattggttgga

SEQ ID NO: 878 - DNA, 20 bp, Artificial Sequence
  Detection oligonucleotide for TMEFF2
ttcgtagaagaatacgcgta

SEQ ID NO: 879 - DNA, 20 bp, Artificial Sequence
  Detection oligonucleotide for TMEFF2
tttgtagaagaatatgtgta

SEQ ID NO: 880 - DNA, 16 bp, Artificial Sequence
  Detection oligonucleotide for STK11
attaatcgtcgttcgg

SEQ ID NO: 881 - DNA, 18 bp, Artificial Sequence
  Detection oligonucleotide for STK11
gattaattgttgtttggg

SEQ ID NO: 882 - DNA, 16 bp, Artificial Sequence
  Detection oligonucleotide for STK11
taatcgttagcggcgg

SEQ ID NO: 883 - DNA, 17 bp, Artificial Sequence
  Detection oligonucleotide for STK11
ttaattgttagtggtgg

SEQ ID NO: 884 - DNA, 16 bp, Artificial Sequence
  Detection oligonucleotide for STK11
gtcgttttcgcgagga

SEQ ID NO: 885 - DNA, 17 bp, Artificial Sequence
  Detection oligonucleotide for STK11
gttgtttttgtgaggag

SEQ ID NO: 886 - DNA, 16 bp, Artificial Sequence
  Detection oligonucleotide for STK11
taatgagcgcgttgta

SEQ ID NO: 887 - DNA, 17 bp, Artificial Sequence
  Detection oligonucleotide for STK11
atgagtgtgttgtattt

SEQ ID NO: 888 - DNA, 16 bp, Artificial Sequence
  Detection oligonucleotide for HSPB1
agggtattcgtcggtt

SEQ ID NO: 889 - DNA, 16 bp, Artificial Sequence
  Detection oligonucleotide for HSPB1
agggtatttgttggtt

SEQ ID NO: 890 - DNA, 16 bp, Artificial Sequence
  Detection oligonucleotide for HSPB1
agtcgtgttacggtag

SEQ ID NO: 891 - DNA, 17 bp, Artificial Sequence
  Detection oligonucleotide for HSPB1
agttgtgttatggtagg

SEQ ID NO: 892 - DNA, 16 bp, Artificial Sequence
  Detection oligonucleotide for HSPB1
gaattcgagagcgcga

SEQ ID NO: 893 - DNA, 17 bp, Artificial Sequence
  Detection oligonucleotide for HSPB1
tgaatttgagagtgtga

SEQ ID NO: 894 - DNA, 18 bp, Artificial Sequence
  Detection oligonucleotide for HSPB1
ttttttcgttaaggaaag

SEQ ID NO: 895 - DNA, 19 bp, Artificial Sequence
  Detection oligonucleotide for HSPB1
ttttttttgttaaggaaag

SEQ ID NO: 896 - DNA, 16 bp, Artificial Sequence
  Detection oligonucleotide for TGFBR2
aaaacgtggacgtttt

SEQ ID NO: 897 - DNA, 17 bp, Artificial Sequence
  Detection oligonucleotide for TGFBR2
gaaaatgtggatgtttt

SEQ ID NO: 898 - DNA, 17 bp, Artificial Sequence
  Detection oligonucleotide for TGFBR2
tgaaagtcggttaaagt

SEQ ID NO: 899 - DNA, 17 bp, Artificial Sequence
  Detection oligonucleotide for TGFBR2
tgaaagttggttaaagt

SEQ ID NO: 900 - DNA, 16 bp, Artificial Sequence
  Detection oligonucleotide for TGFBR2
ttggacgtcgaggaga

SEQ ID NO: 901 - DNA, 16 bp, Artificial Sequence
  Detection oligonucleotide for TGFBR2
ttggatgttgaggaga

SEQ ID NO: 902 - DNA, 16 bp, Artificial Sequence
  Detection oligonucleotide for TGFBR2
ttttcgggcggagaga

SEQ ID NO: 903 - DNA, 16 bp, Artificial Sequence
  Detection oligonucleotide for TGFBR2
aaggtttttgggtgga

SEQ ID NO: 904 - DNA, 17 bp, Artificial Sequence
  Detection oligonucleotide for CSPG2
ttcggttagtttcgtat

SEQ ID NO: 905 - DNA, 19 bp, Artificial Sequence
  Detection oligonucleotide for CSPG2
ttttggttagttttgtatt

SEQ ID NO: 906 - DNA, 17 bp, Artificial Sequence
  Detection oligonucleotide for CSPG2
ttcgggttattacgttt

SEQ ID NO: 907 - DNA, 19 bp, Artificial Sequence
  Detection oligonucleotide for CSPG2
ttttgggttattatgtttt

SEQ ID NO: 908 - DNA, 16 bp, Artificial Sequence
  Detection oligonucleotide for CSPG2
tttagtcgcgtagcgt

SEQ ID NO: 909 - DNA, 18 bp, Artificial Sequence
  Detection oligonucleotide for CSPG2
atttagttgtgtagtgtt

SEQ ID NO: 910 - DNA, 16 bp, Artificial Sequence
  Detection oligonucleotide for CSPG2
aattcgcgagtttaga

SEQ ID NO: 911 - DNA, 18 bp, Artificial Sequence
  Detection oligonucleotide for CSPG2
gaaaaaaatttgtgagtt

SEQ ID NO: 912 - DNA, 16 bp, Artificial Sequence
  Detection oligonucleotide for ERBB2
tgtgagaacggttgta

SEQ ID NO: 913 - DNA, 16 bp, Artificial Sequence
  Detection oligonucleotide for ERBB2
tgagaatggttgtagg

SEQ ID NO: 914 - DNA, 16 bp, Artificial Sequence
  Detection oligonucleotide for ERBB2
ttaggcgtttcggcgt

SEQ ID NO: 915 - DNA, 17 bp, Artificial Sequence
  Detection oligonucleotide for ERBB2
tttaggtgttttggtgt

SEQ ID NO: 916 - DNA, 16 bp, Artificial Sequence
  Detection oligonucleotide for ERBB2
taggtttgcgcgaaga

SEQ ID NO: 917 - DNA, 16 bp, Artificial Sequence
  Detection oligonucleotide for ERBB2
tttgtgtgaagagagg

SEQ ID NO: 918 - DNA, 17 bp, Artificial Sequence
  Detection oligonucleotide for ERBB2
taattatcggagaagga

SEQ ID NO: 919 - DNA, 18 bp, Artificial Sequence
  Detection oligonucleotide for ERBB2
taattattggagaaggag

SEQ ID NO: 920 - DNA, 17 bp, Artificial Sequence
  Detection oligonucleotide for ELK1
ggtcggcgttgatttta

SEQ ID NO: 921 - DNA, 17 bp, Artificial Sequence
  Detection oligonucleotide for ELK1
ggttggtgttgatttta

SEQ ID NO: 922 - DNA, 16 bp, Artificial Sequence
  Detection oligonucleotide for ELK1
gtcgggattcgaacgg

SEQ ID NO: 923 - DNA, 16 bp, Artificial Sequence
  Detection oligonucleotide for ELK1
gttgggatttgaatgg

SEQ ID NO: 924 - DNA, 16 bp, Artificial Sequence
  Detection oligonucleotide for ELK1
gtcggaagtttcggga

SEQ ID NO: 925 - DNA, 17 bp, Artificial Sequence
  Detection oligonucleotide for ELK1
gttggaagttttgggat

SEQ ID NO: 926 - DNA, 18 bp, Artificial Sequence
  Detection oligonucleotide for ELK1
atatcgtagggtaggcgg

SEQ ID NO: 927 - DNA, 18 bp, Artificial Sequence
  Detection oligonucleotide for ELK1
atattgtagggtaggtgg

SEQ ID NO: 928 - DNA, 16 bp, Artificial Sequence
  Detection oligonucleotide for APC
ggtttcgtttaatcgt

SEQ ID NO: 929 - DNA, 18 bp, Artificial Sequence
  Detection oligonucleotide for APC
gggttttgtttaattgta

SEQ ID NO: 930 - DNA, 16 bp, Artificial Sequence
  Detection oligonucleotide for APC
ttcgtatttagcggat

SEQ ID NO: 931 - DNA, 17 bp, Artificial Sequence
  Detection oligonucleotide for APC
ggtttgtatttagtgga

SEQ ID NO: 932 - DNA, 16 bp, Artificial Sequence
  Detection oligonucleotide for APC
atcggcgggttttcga

SEQ ID NO: 933 - DNA, 17 bp, Artificial Sequence
  Detection oligonucleotide for APC
aattggtgggtttttga

SEQ ID NO: 934 - DNA, 16 bp, Artificial Sequence
  Detection oligonucleotide for APC
attttcgagttcggta

SEQ ID NO: 935 - DNA, 17 bp, Artificial Sequence
  Detection oligonucleotide for APC
tttttgagtttggtagt

SEQ ID NO: 936 - DNA, 17 bp, Artificial Sequence
  Detection oligonucleotide for ESR2
atttcgaggattacgtt

SEQ ID NO: 937 - DNA, 19 bp, Artificial Sequence
  Detection oligonucleotide for ESR2
attttgaggattatgtttt

SEQ ID NO: 938 - DNA, 17 bp, Artificial Sequence
  Detection oligonucleotide for ESR2
agatggcgtttttcgta

SEQ ID NO: 939 - DNA, 18 bp, Artificial Sequence
  Detection oligonucleotide for ESR2
tagatggtgttttttgta

SEQ ID NO: 940 - DNA, 18 bp, Artificial Sequence
  Detection oligonucleotide for ESR2
attttcgaatcgattttt

SEQ ID NO: 941 - DNA, 19 bp, Artificial Sequence
  Detection oligonucleotide for ESR2
ggagtatttttgaattgat

SEQ ID NO: 942 - DNA, 16 bp, Artificial Sequence
  Detection oligonucleotide for ESR2
agttcgacggttttag

SEQ ID NO: 943 - DNA, 16 bp, Artificial Sequence
  Detection oligonucleotide for ESR2
agggagtttgatggtt

SEQ ID NO: 944 - DNA, 16 bp, Artificial Sequence
  Detection oligonucleotide for ESR2
agtttacgtgatcgag

SEQ ID NO: 945 - DNA, 18 bp, Artificial Sequence
  Detection oligonucleotide for ESR2
agtttatgtgattgagtt

SEQ ID NO: 946 - DNA, 16 bp, Artificial Sequence
  Detection oligonucleotide for WBP11
ttacgagaagcgggta

SEQ ID NO: 947 - DNA, 17 bp, Artificial Sequence
  Detection oligonucleotide for WBP11
attatgagaagtgggta

SEQ ID NO: 948 - DNA, 16 bp, Artificial Sequence
  Detection oligonucleotide for WBP11
agggggcgattttcgg

SEQ ID NO: 949 - DNA, 17 bp, Artificial Sequence
  Detection oligonucleotide for WBP11
tagggggtgatttttgg

SEQ ID NO: 950 - DNA, 16 bp, Artificial Sequence
  Detection oligonucleotide for WBP11
ttagcgtcgtttgatt

SEQ ID NO: 951 - DNA, 18 bp, Artificial Sequence
  Detection oligonucleotide for WBP11
ttttagtgttgtttgatt

SEQ ID NO: 952 - DNA, 17 bp, Artificial Sequence
  Detection oligonucleotide for WBP11
agttcgttttattgcgt

SEQ ID NO: 953 - DNA, 18 bp, Artificial Sequence
  Detection oligonucleotide for WBP11
gagtttgttttattgtgt

SEQ ID NO: 954 - DNA, 17 bp, Artificial Sequence
  Detection oligonucleotide for CGB
ttacgtcgtggttttta

SEQ ID NO: 955 - DNA, 18 bp, Artificial Sequence
  Detection oligonucleotide for CGB
ttatgttgtggtttttag

SEQ ID NO: 956 - DNA, 16 bp, Artificial Sequence
  Detection oligonucleotide for CGB
ggcgtgaatttcgtgg

SEQ ID NO: 957 - DNA, 17 bp, Artificial Sequence
  Detection oligonucleotide for CGB
ggtgtgaattttgtggt

SEQ ID NO: 958 - DNA, 17 bp, Artificial Sequence
  Detection oligonucleotide for CGB
tttcgagtttattcggt

SEQ ID NO: 959 - DNA, 18 bp, Artificial Sequence
  Detection oligonucleotide for CGB
ttttgagtttatttggtt

SEQ ID NO: 960 - DNA, 16 bp, Artificial Sequence
  Detection oligonucleotide for CGB
ttatcgcgatgtgcgt

SEQ ID NO: 961 - DNA, 17 bp, Artificial Sequence
  Detection oligonucleotide for CGB
attattgtgatgtgtgt

SEQ ID NO: 962 - DNA, 17 bp, Artificial Sequence
  Detection oligonucleotide for ESR1
tgcggttgtatacgtag

SEQ ID NO: 963 - DNA, 17 bp, Artificial Sequence
  Detection oligonucleotide for ESR1
tgtgtggttgtatatgt

SEQ ID NO: 964 - DNA, 20 bp, Artificial Sequence
  Detection oligonucleotide for ESR1
ttcgtgttagatttcgatat

SEQ ID NO: 965 - DNA, 20 bp, Artificial Sequence
  Detection oligonucleotide for ESR1
tttgtgttagattttgatat

SEQ ID NO: 966 - DNA, 16 bp, Artificial Sequence
  Detection oligonucleotide for ESR1
aacgcgaaagacggat

SEQ ID NO: 967 - DNA, 18 bp, Artificial Sequence
  Detection oligonucleotide for ESR1
ataaatgtgaaagatgga

SEQ ID NO: 968 - DNA, 16 bp, Artificial Sequence
  Detection oligonucleotide for ESR1
gggcgtacgaggattt

SEQ ID NO: 969 - DNA, 16 bp, Artificial Sequence
  Detection oligonucleotide for ESR1
gggtgtatgaggattt

SEQ ID NO: 970 - DNA, 16 bp, Artificial Sequence
  Detection oligonucleotide for PITX2
agtcgggagagcgaaa

SEQ ID NO: 971 - DNA, 16 bp, Artificial Sequence
  Detection oligonucleotide for PITX2
agttgggagagtgaaa

SEQ ID NO: 972 - DNA, 17 bp, Artificial Sequence
  Detection oligonucleotide for PITX2
aagagtcgggagtcgga

SEQ ID NO: 973 - DNA, 17 bp, Artificial Sequence
  Detection oligonucleotide for PITX2
aagagttgggagttgga

SEQ ID NO: 974 - DNA, 16 bp, Artificial Sequence
  Detection oligonucleotide for PITX2
ggtcgaagagtcggga

SEQ ID NO: 975 - DNA, 16 bp, Artificial Sequence
  Detection oligonucleotide for PITX2
ggttgaagagttggga

SEQ ID NO: 976 - DNA, 16 bp, Artificial Sequence
  Detection oligonucleotide for PITX2
atgttagcgggtcgaa

SEQ ID NO: 977 - DNA, 16 bp, Artificial Sequence
  Detection oligonucleotide for PITX2
tagtgggttgaagagt

SEQ ID NO: 978 - DNA, 17 bp, Artificial Sequence
  Detection oligonucleotide for PCAF
gagcggtaggtgtcgaa

SEQ ID NO: 979 - DNA, 17 bp, Artificial Sequence
  Detection oligonucleotide for PCAF
gagtggtaggtgttgaa

SEQ ID NO: 980 - DNA, 16 bp, Artificial Sequence
  Detection oligonucleotide for PCAF
taagatttcgcgggta

SEQ ID NO: 981 - DNA, 18 bp, Artificial Sequence
  Detection oligonucleotide for PCAF
tgtaagattttgtgggta

SEQ ID NO: 982 - DNA, 16 bp, Artificial Sequence
  Detection oligonucleotide for PCAF
agttcgtagtttcgag

SEQ ID NO: 983 - DNA, 17 bp, Artificial Sequence
  Detection oligonucleotide for PCAF
gtttgtagttttgagga

SEQ ID NO: 984 - DNA, 16 bp, Artificial Sequence
  Detection oligonucleotide for PCAF
tagggcgcggagtaga

SEQ ID NO: 985 - DNA, 16 bp, Artificial Sequence
  Detection oligonucleotide for PCAF
tagggtgtggagtaga

SEQ ID NO: 986 - DNA, 16 bp, Artificial Sequence
  Detection oligonucleotide for PCAF
agcgtcggtacgtata

SEQ ID NO: 987 - DNA, 16 bp, Artificial Sequence
  Detection oligonucleotide for PCAF
ggtagtgttggtatgt

SEQ ID NO: 988 - DNA, 16 bp, Artificial Sequence
  Detection oligonucleotide for TBC1D3
tattcgcgggcggttt

SEQ ID NO: 989 - DNA, 16 bp, Artificial Sequence
  Detection oligonucleotide for TBC1D3
tagtatttgtgggtgg

SEQ ID NO: 990 - DNA, 16 bp, Artificial Sequence
  Detection oligonucleotide for TBC1D3
attcggcgggagatta

SEQ ID NO: 991 - DNA, 16 bp, Artificial Sequence
  Detection oligonucleotide for TBC1D3
agtaaatttggtggga

SEQ ID NO: 992 - DNA, 17 bp, Artificial Sequence
  Detection oligonucleotide for TBC1D3
agattagtcgaaagagt

SEQ ID NO: 993 - DNA, 18 bp, Artificial Sequence
  Detection oligonucleotide for TBC1D3
gagattagttgaaagagt

SEQ ID NO: 994 - DNA, 18 bp, Artificial Sequence
  Detection oligonucleotide for TBC1D3
tatatttcggggttttaa

SEQ ID NO: 995 - DNA, 19 bp, Artificial Sequence
  Detection oligonucleotide for TBC1D3
tatattttggggttttaaa

SEQ ID NO: 996 - DNA, 17 bp, Artificial Sequence
  Detection oligonucleotide for ABCA8
atttggtttcgaagttt

SEQ ID NO: 997 - DNA, 18 bp, Artificial Sequence
  Detection oligonucleotide for ABCA8
tatttggttttgaagttt

SEQ ID NO: 998 - DNA, 16 bp, Artificial Sequence
  Detection oligonucleotide for ABCA8
ttttcggaattcgggt

SEQ ID NO: 999 - DNA, 17 bp, Artificial Sequence
  Detection oligonucleotide for ABCA8
ttttggaatttgggtgt

SEQ ID NO: 1000 - DNA, 17 bp, Artificial Sequence
  Detection oligonucleotide for ABCA8
tttcggtttttaacggt

SEQ ID NO: 1001 - DNA, 18 bp, Artificial Sequence
  Detection oligonucleotide for ABCA8
ttttggtttttaatggtg

SEQ ID NO: 1002 - DNA, 16 bp, Artificial Sequence
  Detection oligonucleotide for ABCA8
aaaatttacgagggga

SEQ ID NO: 1003 - DNA, 18 bp, Artificial Sequence
  Detection oligonucleotide for ABCA8
ttaaaatttatgagggga

SEQ ID NO: 1004 - DNA, 17 bp, Artificial Sequence
  Detection oligonucleotide for BCL6
atttcgaaatatgtcgg

SEQ ID NO: 1005 - DNA, 18 bp, Artificial Sequence
  Detection oligonucleotide for BCL6
attttgaaatatgttggt

SEQ ID NO: 1006 - DNA, 16 bp, Artificial Sequence
  Detection oligonucleotide for BCL6
attcgagacgttttgt

SEQ ID NO: 1007 - DNA, 18 bp, Artificial Sequence
  Detection oligonucleotide for BCL6
tttgagatgttttgttta

SEQ ID NO: 1008 - DNA, 17 bp, Artificial Sequence
  Detection oligonucleotide for BCL6
ttcgagtttcgaatcgg

SEQ ID NO: 1009 - DNA, 18 bp, Artificial Sequence
  Detection oligonucleotide for BCL6
tttgagttttgaattgga

SEQ ID NO: 1010 - DNA, 16 bp, Artificial Sequence
  Detection oligonucleotide for BCL6
atagcgaaggcgtcga

SEQ ID NO: 1011 - DNA, 17 bp, Artificial Sequence
  Detection oligonucleotide for BCL6
tatagtgaaggtgttga

SEQ ID NO: 1012 - DNA, 16 bp, Artificial Sequence
  Detection oligonucleotide for STMN1
ttaggcggttcggatt

SEQ ID NO: 1013 - DNA, 16 bp, Artificial Sequence
  Detection oligonucleotide for STMN1
ttaggtggtttggatt

SEQ ID NO: 1014 - DNA, 16 bp, Artificial Sequence
  Detection oligonucleotide for STMN1
tatcggttcgggaatt

SEQ ID NO: 1015 - DNA, 17 bp, Artificial Sequence
  Detection oligonucleotide for STMN1
tattggtttgggaattt

SEQ ID NO: 1016 - DNA, 16 bp, Artificial Sequence
  Detection oligonucleotide for STMN1
tttcgcgcggaggtta

SEQ ID NO: 1017 - DNA, 16 bp, Artificial Sequence
  Detection oligonucleotide for STMN1
ttttgtgtggaggtta

SEQ ID NO: 1018 - DNA, 18 bp, Artificial Sequence
  Detection oligonucleotide for STMN1
ggtaagaacgtatatagt

SEQ ID NO: 1019 - DNA, 19 bp, Artificial Sequence
  Detection oligonucleotide for STMN1
tggtaagaatgtatatagt

SEQ ID NO: 1020 - DNA, 16 bp, Artificial Sequence
  Detection oligonucleotide for STMN1
tttcggttaatgcgga

SEQ ID NO: 1021 - DNA, 17 bp, Artificial Sequence
  Detection oligonucleotide for STMN1
tttttggttaatgtgga

SEQ ID NO: 1022 - DNA, 16 bp, Artificial Sequence
  Detection oligonucleotide for STMN1
tacgttcgcgatttgt

SEQ ID NO: 1023 - DNA, 16 bp, Artificial Sequence
  Detection oligonucleotide for STMN1
agggttatgtttgtga

SEQ ID NO: 1024 - DNA, 16 bp, Artificial Sequence
  Detection oligonucleotide for STMN1
gatacgtcggtgtcgg

SEQ ID NO: 1025 - DNA, 17 bp, Artificial Sequence
  Detection oligonucleotide for STMN1
tgatatgttggtgttgg

SEQ ID NO: 1026 - DNA, 16 bp, Artificial Sequence
  Detection oligonucleotide for STMN1
ttacggcgagattatt

SEQ ID NO: 1027 - DNA, 19 bp, Artificial Sequence
  Detection oligonucleotide for STMN1
ttttatggtgagattattt

SEQ ID NO: 1028 - DNA, 16 bp, Artificial Sequence
  Detection oligonucleotide for VTN
ttcgggttcgcgaaag

SEQ ID NO: 1029 - DNA, 16 bp, Artificial Sequence
  Detection oligonucleotide for VTN
tttgggtttgtgaaag

SEQ ID NO: 1030 - DNA, 16 bp, Artificial Sequence
  Detection oligonucleotide for VTN
ttttgttcgcgttgaa

SEQ ID NO: 1031 - DNA, 17 bp, Artificial Sequence
  Detection oligonucleotide for VTN
ttgtttgtgttgaagta

SEQ ID NO: 1032 - DNA, 16 bp, Artificial Sequence
  Detection oligonucleotide for VTN
tgggtcgcgaggtagt

SEQ ID NO: 1033 - DNA, 16 bp, Artificial Sequence
  Detection oligonucleotide for VTN
tgggttgtgaggtagt

SEQ ID NO: 1034 - DNA, 16 bp, Artificial Sequence
  Detection oligonucleotide for VTN
ggtggtatcgattgat

SEQ ID NO: 1035 - DNA, 17 bp, Artificial Sequence
  Detection oligonucleotide for VTN
tggtggtattgattgat

SEQ ID NO: 1036 - DNA, 17 bp, Artificial Sequence
  Detection oligonucleotide for VTN
ttcgatggcggtttcga

SEQ ID NO: 1037 - DNA, 17 bp, Artificial Sequence
  Detection oligonucleotide for VTN
tttgatggtggttttga

SEQ ID NO: 1038 - DNA, 16 bp, Artificial Sequence
  Detection oligonucleotide for VTN
tagtgattcgcgggga

SEQ ID NO: 1039 - DNA, 16 bp, Artificial Sequence
  Detection oligonucleotide for VTN
tagtgatttgtgggga

SEQ ID NO: 1040 - DNA, 16 bp, Artificial Sequence
  Detection oligonucleotide for VTN
ttatgtcggaggatga

SEQ ID NO: 1041 - DNA, 17 bp, Artificial Sequence
  Detection oligonucleotide for VTN
attatgttggaggatga

SEQ ID NO: 1042 - DNA, 17 bp, Artificial Sequence
  Detection oligonucleotide for VTN
atacggtttatgacgat

SEQ ID NO: 1043 - DNA, 19 bp, Artificial Sequence
  Detection oligonucleotide for VTN
atatggtttatgatgatgg

SEQ ID NO: 1044 - DNA, 16 bp, Artificial Sequence
  Detection oligonucleotide for PLAU
tatttgtcgcgttgat

SEQ ID NO: 1045 - DNA, 17 bp, Artificial Sequence
  Detection oligonucleotide for PLAU
atttgttgtgttgatga

SEQ ID NO: 1046 - DNA, 16 bp, Artificial Sequence
  Detection oligonucleotide for PLAU
tgtaattcggggattt

SEQ ID NO: 1047 - DNA, 17 bp, Artificial Sequence
  Detection oligonucleotide for PLAU
ttgtaatttggggattt

SEQ ID NO: 1048 - DNA, 16 bp, Artificial Sequence
  Detection oligonucleotide for PLAU
aggaagtacggagaat

SEQ ID NO: 1049 - DNA, 17 bp, Artificial Sequence
  Detection oligonucleotide for PLAU
aggaagtatggagaatt

SEQ ID NO: 1050 - DNA, 17 bp, Artificial Sequence
  Detection oligonucleotide for PLAU
ttcgttggagatcgcgt

SEQ ID NO: 1051 - DNA, 17 bp, Artificial Sequence
  Detection oligonucleotide for PLAU
tttgttggagattgtgt

SEQ ID NO: 1052 - DNA, 16 bp, Artificial Sequence
  Detection oligonucleotide for PLAU
ttgcggaagtacgcgg

SEQ ID NO: 1053 - DNA, 16 bp, Artificial Sequence
  Detection oligonucleotide for PLAU
ttgtggaagtatgtgg

SEQ ID NO: 1054 - DNA, 16 bp, Artificial Sequence
  Detection oligonucleotide for (Chr. 1p13.2)
taaattcgacgggttt

SEQ ID NO: 1055 - DNA, 17 bp, Artificial Sequence
  Detection oligonucleotide for (Chr. 1p13.2)
atttgatgggtttttgt

SEQ ID NO: 1056 - DNA, 16 bp, Artificial Sequence
  Detection oligonucleotide for (Chr. 1p13.2)
ttttcgttcggcggag

SEQ ID NO: 1057 - DNA, 17 bp, Artificial Sequence
  Detection oligonucleotide for (Chr. 1p13.2)
tttgtttggtggaggtt

SEQ ID NO: 1058 - DNA, 16 bp, Artificial Sequence
  Detection oligonucleotide for (Chr. 1p13.2)
ttcgcgtttatcgtgt

SEQ ID NO: 1059 - DNA, 17 bp, Artificial Sequence
  Detection oligonucleotide for (Chr. 1p13.2)
tggtttgtgtttattgt

SEQ ID NO: 1060 - DNA, 16 bp, Artificial Sequence
  Detection oligonucleotide for (Chr. 1p13.2)
tttcgcggttcgtagt

SEQ ID NO: 1061 - DNA, 18 bp, Artificial Sequence
  Detection oligonucleotide for (Chr. 1p13.2)
tttgtggtttgtagttta

SEQ ID NO: 1062 - DNA, 19 bp, Artificial Sequence
  Detection oligonucleotide for GRB7
atagtttcgttatttgtat

SEQ ID NO: 1063 - DNA, 19 bp, Artificial Sequence
  Detection oligonucleotide for GRB7
ggtatagttttgttatttg

SEQ ID NO: 1064 - DNA, 16 bp, Artificial Sequence
  Detection oligonucleotide for GRB7
tttagtacggggtgta

SEQ ID NO: 1065 - DNA, 17 bp, Artificial Sequence
  Detection oligonucleotide for GRB7
ttttagtatggggtgta

SEQ ID NO: 1066 - DNA, 18 bp, Artificial Sequence
  Detection oligonucleotide for GRB7
ggcgttatagttacgttt

SEQ ID NO: 1067 - DNA, 18 bp, Artificial Sequence
  Detection oligonucleotide for GRB7
gggtgttatagttatgtt

SEQ ID NO: 1068 - DNA, 17 bp, Artificial Sequence
  Detection oligonucleotide for GRB7
tgtttatcgaaggtaga

SEQ ID NO: 1069 - DNA, 18 bp, Artificial Sequence
  Detection oligonucleotide for GRB7
tgtttattgaaggtagaa

SEQ ID NO: 1070 - DNA, 16 bp, Artificial Sequence
  Detection oligonucleotide for (Chr. 8q12.1)
tattcgggtttcgcga

SEQ ID NO: 1071 - DNA, 16 bp, Artificial Sequence
  Detection oligonucleotide for (Chr. 8q12.1)
atttgggttttgtgag

SEQ ID NO: 1072 - DNA, 16 bp, Artificial Sequence
  Detection oligonucleotide for (Chr. 8q12.1)
tattgttacgcgtcga

SEQ ID NO: 1073 - DNA, 18 bp, Artificial Sequence
  Detection oligonucleotide for (Chr. 8q12.1)
attgttatgtgttgattt

SEQ ID NO: 1074 - DNA, 16 bp, Artificial Sequence
  Detection oligonucleotide for (Chr. 8q12.1)
gacgtgtaggtcgtat

SEQ ID NO: 1075 - DNA, 17 bp, Artificial Sequence
  Detection oligonucleotide for (Chr. 8q12.1)
gatgtgtaggttgtatt

SEQ ID NO: 1076 - DNA, 16 bp, Artificial Sequence
  Detection oligonucleotide for (Chr. 8q12.1)
ttcgggaacgattttt

SEQ ID NO: 1077 - DNA, 16 bp, Artificial Sequence
  Detection oligonucleotide for (Chr. 8q12.1)
gggtttgggaatgatt

SEQ ID NO: 1078 - DNA, 16 bp, Artificial Sequence
  Detection oligonucleotide for COX7A2L
ttgttcgaagatcgtt

SEQ ID NO: 1079 - DNA, 18 bp, Artificial Sequence
  Detection oligonucleotide for COX7A2L
gttgtttgaagattgttt

SEQ ID NO: 1080 - DNA, 17 bp, Artificial Sequence
  Detection oligonucleotide for COX7A2L
tagcgtaaggattcggt

SEQ ID NO: 1081 - DNA, 18 bp, Artificial Sequence
  Detection oligonucleotide for COX7A2L
ttagtgtaaggatttggt

SEQ ID NO: 1082 - DNA, 18 bp, Artificial Sequence
  Detection oligonucleotide for COX7A2L
agagttcggtttttcgta

SEQ ID NO: 1083 - DNA, 18 bp, Artificial Sequence
  Detection oligonucleotide for COX7A2L
agagtttggttttttgta

SEQ ID NO: 1084 - DNA, 18 bp, Artificial Sequence
  Detection oligonucleotide for COX7A2L
attcgtatttgcgggtta

SEQ ID NO: 1085 - DNA, 18 bp, Artificial Sequence
  Detection oligonucleotide for COX7A2L
atttgtatttgtgggtta

SEQ ID NO: 1086 - DNA, 16 bp, Artificial Sequence
  Detection oligonucleotide for COX7A2L
aattcgatcgcgggta

SEQ ID NO: 1087 - DNA, 17 bp, Artificial Sequence
  Detection oligonucleotide for COX7A2L
atttgattgtgggtaga

SEQ ID NO: 1088 - DNA, 25 bp, Artificial Sequence
  chemically treated genomic DNA (Homo sapiens)
tggtgatggaggaggtttagtaagt

SEQ ID NO: 1089 - DNA, 27 bp, Artificial Sequence
  chemically treated genomic DNA (Homo sapiens)
aaccaataaaacctactcctcccttaa

SEQ ID NO: 1090 - DNA, 30 bp, Artificial Sequence
  chemically treated genomic DNA (Homo sapiens)
accaccacccaacacacaataacaaacaca

SEQ ID NO: 1091 - DNA, 22 bp, Artificial Sequence
  chemically treated genomic DNA (Homo sapiens)
gtaggggagggaagtagatgtt

SEQ ID NO: 1092 - DNA, 24 bp, Artificial Sequence
  chemically treated genomic DNA (Homo sapiens)
ttctaatcctcctttccacaataa

SEQ ID NO: 1093 - DNA, 20 bp, Artificial Sequence
  chemically treated genomic DNA (Homo sapiens)
agtcggagtcgggagagcga

SEQ ID NO: 1094 - DNA, 27 bp, Artificial Sequence
  chemically treated genomic DNA (Homo sapiens)
agttggagttgggagagtgaaaggaga

SEQ ID NO: 1095 - DNA, 20 bp, Artificial Sequence
  chemically treated genomic DNA (Homo sapiens)
ggagtggaggaaattgagat

SEQ ID NO: 1096 - DNA, 22 bp, Artificial Sequence
  chemically treated genomic DNA (Homo sapiens)
ccacacaacaaatactcaaaac

SEQ ID NO: 1097 - DNA, 33 bp, Artificial Sequence
  chemically treated genomic DNA (Homo sapiens)
tgggtgtttgtaatttttgttttgtgttaggtt

SEQ ID NO: 1098 - DNA, 22 bp, Artificial Sequence
  chemically treated genomic DNA (Homo sapiens)
gtaggggagggaagtagatgtt

SEQ ID NO: 1099 - DNA, 24 bp, Artificial Sequence
  chemically treated genomic DNA (Homo sapiens)
ttctaatcctcctttccacaataa

SEQ ID NO: 1100 - DNA, 20 bp, Artificial Sequence
  chemically treated genomic DNA (Homo sapiens)
agtcggagtcgggagagcga

SEQ ID NO: 1101 - DNA, 27 bp, Artificial Sequence
  chemically treated genomic DNA (Homo sapiens)
agttggagttgggagagtgaaaggaga

SEQ ID NO: 1102 - DNA, 22 bp, Artificial Sequence
  chemically treated genomic DNA (Homo sapiens)
aacatctacttccctcccctac

SEQ ID NO: 1103 - DNA, 32 bp, Artificial Sequence
  chemically treated genomic DNA (Homo sapiens)
gttagtagagattttattaaattttattgtat

SEQ ID NO: 1104 - DNA, 14 bp, Artificial Sequence
  chemically treated genomic DNA (Homo sapiens)
ttcggttgcgcggt

SEQ ID NO: 1105 - DNA, 16 bp, Artificial Sequence
  chemically treated genomic DNA (Homo sapiens)
tttggttgtgtggttg

SEQ ID NO: 1106 - DNA, 22 bp, Artificial Sequence
  chemically treated genomic DNA (Homo sapiens)
gttaggtgtatgggaggaagta

SEQ ID NO: 1107 - DNA, 19 bp, Artificial Sequence
  chemically treated genomic DNA (Homo sapiens)
tccctcccctatcttacaa

SEQ ID NO: 1108 - DNA, 20 bp, Artificial Sequence
  chemically treated genomic DNA (Homo sapiens)
acccgaaccccgcgtacttc

SEQ ID NO: 1109 - DNA, 24 bp, Artificial Sequence
  chemically treated genomic DNA (Homo sapiens)
acccaaaccccacatacttccaca

SEQ ID NO: 1110 - DNA, 25 bp, Artificial Sequence
  chemically treated genomic DNA (Homo sapiens)
gtaggaagaggtgttgagaaattaa

SEQ ID NO: 1111 - DNA, 25 bp, Artificial Sequence
  chemically treated genomic DNA (Homo sapiens)
ccacacaaaaaatttctatactcct

SEQ ID NO: 1112 - DNA, 18 bp, Artificial Sequence
  chemically treated genomic DNA (Homo sapiens)
acgggtagaggcgcgggt

SEQ ID NO: 1113 - DNA, 30 bp, Artificial Sequence
  chemically treated genomic DNA (Homo sapiens)
atgggtagaggtgtgggttatattgttttg

SEQ ID NO: 1114 - DNA, 26 bp, Artificial Sequence
  chemically treated genomic DNA (Homo sapiens)
gtgaggtattggatttagtttatttg

SEQ ID NO: 1115 - DNA, 24 bp, Artificial Sequence
  chemically treated genomic DNA (Homo sapiens)
ccctaaatctcatcctaaaaacac

SEQ ID NO: 1116 - DNA, 24 bp, Artificial Sequence
  chemically treated genomic DNA (Homo sapiens)
tgaggtttcggtttttaacggtgg

SEQ ID NO: 1117 - DNA, 27 bp, Artificial Sequence
  chemically treated genomic DNA (Homo sapiens)
tgaggttttggtttttaatggtgggat

SEQ ID NO: 1118 - DNA, 24 bp, Artificial Sequence
  chemically treated genomic DNA (Homo sapiens)
ggagggggtagagttattagtttt

SEQ ID NO: 1119 - DNA, 21 bp, Artificial Sequence
  chemically treated genomic DNA (Homo sapiens)
actcccaacttcactttctcc

SEQ ID NO: 1120 - DNA, 24 bp, Artificial Sequence
  chemically treated genomic DNA (Homo sapiens)
taatttaggcgtttcggcgttagg

SEQ ID NO: 1121 - DNA, 29 bp, Artificial Sequence
  chemically treated genomic DNA (Homo sapiens)
taatttaggtgttttggtgttaggaggga

SEQ ID NO: 1122 - DNA, 23 bp, Artificial Sequence
  chemically treated genomic DNA (Homo sapiens)
agttggtgatgttgattagagtt

SEQ ID NO: 1123 - DNA, 26 bp, Artificial Sequence
  chemically treated genomic DNA (Homo sapiens)
ccctcccaatatacaaataaaaacta

SEQ ID NO: 1124 - DNA, 15 bp, Artificial Sequence
  chemically treated genomic DNA (Homo sapiens)
acaccgttcgtaaaa

SEQ ID NO: 1125 - DNA, 16 bp, Artificial Sequence
  chemically treated genomic DNA (Homo sapiens)
acaccattcataaaat

SEQ ID NO: 1126 - DNA, 27 bp, Artificial Sequence
  chemically treated genomic DNA (Homo sapiens)
tttttagttggtttttattagggtttt

SEQ ID NO: 1127 - DNA, 22 bp, Artificial Sequence
  chemically treated genomic DNA (Homo sapiens)
ccaacatatccacccacttact

SEQ ID NO: 1128 - DNA, 21 bp, Artificial Sequence
  chemically treated genomic DNA (Homo sapiens)
tttcgactaatctcccgccga

SEQ ID NO: 1129 - DNA, 32 bp, Artificial Sequence
  chemically treated genomic DNA (Homo sapiens)
tttcaactaatctcccaccaaatttactatca

SEQ ID NO: 1130 - DNA, 28536 bp, Homo Sapiens
gctctgggagctaggtttctctcgctggatgggaaaaggaggtgcggaaaggggcaggcggcctgcgggctagcggggatgagagttgtggggagaacggaggagagagtaaaattattccttttggaagtccaagggaagggagctgaggtgagagaaatggcctctcttaggtcccaagtctccgcccccagcctgcaccactcaagtcggggaagtgacaactcttcctaaacctcgacttccattttttgtttcctgcagattgattgatgtcctcgcgttgttctagttcagcaaccaaactaggccgaggtacacctcttttacccagagctcccaaatcactcaccaacctgcaggagacctaaatcctccgggcaggtctcgttagcgcttccagcccccatccccaaatcccctcttctagctccttccttcccctccgccctttggccctccccgccccctaccaggctgagaggcggagaggccgggaccgctgggccctgcggctccagaagccaaagtccgcccgtggggaccgttttcctctccactgctctcaagtgaacaacatggtgggaggtgaccctcgtccaaagggcttttatctgccccccactgctgcgtgatccctccgcaagtcggaggcagagctttaaaaagaaagaaagtgtgcgttgagcactgatcttaaatcggggacattatctgcgatctctttaagtggcagcagcagtttcttgcagaacaaagactcagtgttcgagctccaaaagcttctaggtaaagtttcattcagatgaaagcaactaaggcgaaaaaacaatgatattgtcggctccagaaaatcggcggttactttttgctctaagttccccagcgtggtgtttgttctcgcccactttggttgtgcggggggttgacaagcataacaaaagatctcagcacatccctccccccacctccacaacgaccctcctagcgccatgaggatgaattctctgggactaagtggtatttgtttctatttgttatgaaatcaaatttcacatttttttaaagctgaaaatcgcggataaagaaggatcgggtgcttaaagttcatttaaacactcacaccgaactcattccctgtttagatgtcagaggatggcagggagggccagggctgtaattcatcttgatttgcttcattgtcctgcagtttgcaaactataatcctgtataatttcaggaacaagcaggtttagaattaatgggtcaatattatttaaaacaaaacaccgggagcatgacctttgcctcaactacatattgctcgacaagactcaggaaactccactctaacctctcaacccctgagttctttgagaaactgaagggctgtagttattagaaatcatctttgtttcttttaatgtctccaaaggatttggaaatagtaatgcaatataacatgaaggatctctctacttaagcctgaagataaacgtggaagcctaaatattttgaactggagatgtttccctgtaaatttattatagatgtattcctcctgagagaaatgcatataaactatacatgtatacatgcacaaatatttctccagaacaatttgctagaggtgtaggtttccccgtaaaggagtaaacttgagagtcattttaagctgatggacttgctaaatttctttcttcttttttctttttcatattatttgctagccataatggaatcctctaggtttaagccaaagaaaaattggagagacaaaattagattttgtagcccttttcccccccgggaatgcctttttttttctttttagtttctgatgaatggctatcatttatttctaccaaatttaaataaggactgctgccttgtatgtttaactaggcaggcagagggaactggtttgtttaggaagcagtgactgagatgtcctggccaagttagtgacagaggaggggagaaagaatccagaccaatttgtatgcagtatattttactcccatgaaataaaacacatttgtttcatatttgctgaaaagtaaaacaataatattgtacgaaatgttatacacagggtaggttgtacatagcagtttcagaaacatcattgcatccaccagagaaactattctaaaactgatattcacacattttttataataataataatatgttagaaacatacagtgtggcatttagtatatacactcccttgctcgcaagcgaaaaatcctaatcgcttctgtataacatgctttattttaaagcctaacctttaaaaacactgttgtgatattactaacaactgcttttataaaattaatttgacatttcgatatatatacatcctttcagtcatttaaatgttaacaatgctaaacttaaaaaataacaagcttatagtaatgttaaaatgtcatatccagtcaaacatttgtttgtgtatgtgtccttgcaactgttagaaatacttgtagtgaaagatgtcagacactgaggacatccctttgaaatcaaaggagctctctctttgattcagtggtttccttttctctatatagcttctctttctctccctttctttagtgcccacgaccttctagcataattcccagtctttcaagggcggagttgccccatccggcaaggtcctaggatcccggcgctgtgggtgcggctcacacgggccggtccactgcatactggcaagcactcaggttggaggccgggttctgcacgctggcgtagccgaagctggagtgctgctttgctttcagtctcaggctggccaggctcgagttacacgtgtccctataaacatacggaggagtcggcggcgcgtaaggacaggcaggcgtcggcaccgcggaattcagcgacgggctactcaggttgttcaagttattcaggctgttgagactggagcccgggacgcctgtcactgctgagggcaccatgctggacgacatgctcatggacgagatagagttgggtggggaaaacatgctctgtgatgacagggggttgacgttcatagagttgaagaaggggaagctcttggtggatagggaggcggatgtaaggcccttggcggcccagttgttgtaggaatagcctgggtacatgtcgtcgtagggctgcatgagcccattgaactgcggcccgaagccattcttgcatagctcggcctgctggttgcgctccctctttctccatttggcccgacgattcttgaaccaaacctgggggcggttggggcaagggagcaaacagatgccacagtgcagattactaaaacttccatcggaggccaacccccgccttcccccgacacacacgctagcgcactcacacaccctggcctcgcttcactgcaccgccctgcacaccaagataccagggccagctttcagttactggcccgggtctccaccaagcgcaggagacctggtctgctctggcctgcgagctgggactcggagctacgccacaaacctcagccgaacgcatggagacctgcggacggtttgatcactcagccaggcgtttctccaggtccaaaaacacttaatgtaaaacaaacgcggggcagcaggcttttccaacccttcccggggcaccttgcaaacttgcttccattccaaagccacagacccacggatgaggagaaggggctggaagggcactagaggatcgctctttctcccacgcaattcctcccttccttccctgacctccactgtcgtcccccaccccctggtacgtgctcccttaacagggactaggccgccaacactctttctcgcctagcaaaacaaccaaataaagagcaaaagaccacctcttcgtcagctcgttaactccaggagcttggcatattaaactccgggaacccggaaagggtagttttggagattcccccttctttcgctctgcctcttctttaccctaagcccaccacaggcctgtccgcgcgccaggcccagccgggtcgtttggctttgcaggcggccacccaggccggccggcttccacccgtgtccggtggcccagccgcaaccccgatcccaatccacatcgggcctccctgtcgccccagacggcggcttttgtgtattggagagaggcctggcctgagatatccgagctgacaccagtgatgtttcacattacacatctccgccgggcccagccgtgtaatccgctttttctctttttcctttcattcttgatttcctttttatcccccttcctctttgcacccgactgctataaaaagcacgcctcactcccacttggctcgacaagcagccgccctggaaggagaggcagctgcaaggagagcccagcgccgcggctacaaagcactagggtggagctgcggaatagcgggcggggtgggagggcgttttcgaaggatcccagaaaacccatagactctgtctttaattacttgccatttctaccctaggccatctaaactttgctcaggcgagaagagtacgtgagaggcccgttcccttgatgtgcaagagagctaatgaaagactgaccttgctcaaaaccacgccgcccaggacccagctctggctctggacagttaaactaaaaccattttcaacttcttcccggccttttatccaccagcatagcctcatgccttgcacaaatgccacccagagagtgtcttcattccctctgatttgggagagcattttggtctttattctttttatcgttgttttcttctttttgtttgctctgctctaaccgggggctttattttttctacccagagcacttaattttttttttttaacagcaaagcctctggatgccgcttgatttgcttgattctgttttctgcttccagaatcctaacaaatttggaatcttccaccgaccagcataaaccaggacgttgctattgggttatttatttgagctcatttttgccaatccataaagtacagatttgctacaaagttaaggtaagccctttttacaaaactatgattataatttagaagagggggtgtgagtttcaatttccagagttcaactcctgagagaagataaataaaccaagcagaaaagtctttcttctttttttctttctccttctaagaggactagtagttgtgtattaaaactttgctcccggagatcacaaaactaggaaatagggtgtgtgggagagacctgaatggccgaaacaaccgtaaagaaggtgtaagaagcgcgagcccaggagggaaaaagctgggccagggccgggacaaaggtttcccagggagggccaactcttccgtgtctctggcgggttttccttgttaaaggctcacaggttggagcctgttcgcggctcttggcctggtagggattttattagctctgctctggcaactgcaagccaggaacacaatgtcctgtgcaggggattgcccatgcagcccagctcgtgagatcgcgggatggcggggcagtgagccggtgccgctctgggagcctgagccagggcggcagtcctgtcggcctcggagagggaactgtaatctcgcaaccaggccgccgcgaggccttctgcctttgcaaagctgcgccccaccggcgccctcccaggcggcgctgccttccacattctctcctggtctacttggcctgtacctccacaacatcctccccccatccctcccagactccgtgctggctcctacccggactcgggcttccgtaaggttggtccacacagcgatttcttcgcgtgtggacatgtccgggtagcggttcctctggaaagtggcctccagctcctggagctgctggctggtaaagtgagtccgctgccgcctttgccgcttcttcttagacgggtcctcggcgcccacgtcctcattcttcccctgctggcttttatctttctctgaaaacgaaacacacacactttcccgtcagcatgcccacctgcaacgcggacgccaactggaccggcggcagaagccgtggaagagctgggctgcctggcgccggaggagggtgcgcgcggcggctccgggccgcgaggagcgctgcgcctgtggggtgtgcaggcgcaagtgtgggtgtccgcgccccatttcctcccctcccccagcgccgcacgttttatttacatgtttatctcactgcagcggcacattcacttttatagcctgtgctttcaagtatatttatacacctctgcgcagacacaccaaatctcctgggacgcgcacacgcgcgtggtttacagacccccctccccctcgcagaaagctcagatttccatgcggtttgggaaggctaggaaaagatgtggggattcggttgggcaccgaagttcgccggccctttcccaaaaaaaaaaaaaaaatgcctcttcgcgaagggcatttctgagtggtttcaggcaatttcctaacgagtggagctcctcgggagctgaaagccgagaggaaaacagggacagaggtcggcggcctctgaaggtcctcgaatcaagatgctgggatttttgtgacccaggaaacagaagggaggccagggtacgaatagagagggcggcagaattgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttggggcgagagggagcgggtggcgcagagcagctgagcgggaatgtctgcagggcggcgcggcgccttacctgcggcctccgggctggaggtgtcggagatggtgtgcacctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatggacgagggagcgcgacgctctactagtccttggctactgccccgccgagcccccgtagccgccgctgcccgctccgggtcgcgctctaggcgcggagtttccccgctgcggggagagccaggggacgcaacccccgccgagttctcaagccaagctgcccccgtctcctccggaaggctcaagcgaaaaagtccggagacggaaagtcagcgggcaaacgaagacatgggatgtgggcagaagggcaccactcagagcgtctttagggagcaggcttccaagctccaaagcgaaacaagagtgggcaaagacccccttcttctctccctccctcccccaagaacccctccaataaggaaagctaacgccgaccgcgctctgcccgccccccccccacgcggcagccctgacagagaagtgtcaagagtgacagggacaggtaggtgatattagatcccctgcggcggcagcagccgctgcagccacgacgcggccctctgagcgcaccctccgcaacgcgcacacgcacacccctcgggcggtcgaacaggagccgggccttgccgcagctcagctccaggcacccaggcgagcgacggaccagatctgcggctccgcgcttccctgttggcctaacatcttaaaaccagaggcgggcttcctggtgccgagacgtcactccgccgcggccctccccagccctctccgcctccgcctcctcccagacccttctccgggtgcgactgacgtggctccgcaccaatcaggacgccccgagccgcggtggagggactgtcctgcctgcacctatcagcagtgcggggccgggctactgcctcgccgtgcgcactgggtctacacaggcaagctcccgggaattcagctcctgcccagcccaaggcgatccggcttttagtacgaacccaaaggtgaagagatgaggctaggagtcgaaggcttgggagaagagagtggaatggtcaagaagagaaaggtacaaggatcaacaagacacccactctttgtgtctcactacatccatttccaatcccccaccccatataaaaaggagacacgttacttaaaactagaaaatttgaaaaacagcaacaaatcacctctccgatcttaaattttccaaacagcctgtcaagtgaatgctgcgctaatctgaagaagctttaattgcaaagaagacagagccctgaaaaggcaggctaataaattagaaatcgagaagcaaatggacccgtcaaaagaaaattaccttgactttaaacgaacaactgtttggtggttcactctggatttatacaagaataaaaagtcgcctcagatcacgttctctgtgatgcttattagtccccagacagaaaacacacaatagaagagaaaccctaacccagcgttttcaaaatgctgaaagcttatccattctacttaacgttgattaagacacatatcctagatctttcaaattccttgtacactgtattaagctcgtcctaacccgagagagccacgctttaaattcgactctcttgtttactttattatcaatcagatttaaatccataaagcctgtagaatcaacaaccttgagctaattatatatgaaatatgccttaatgaatttccatacaattaagaatgttgccaaataaccaatttcaaggataatttttaacagtcattttcttttcccagtgagctcaaggctgtcttgagccattaaagtccaagcaggcagaaggggtgtgtgtgagctaagggcgaaaagcctagaactgcgctcaactagcaaaagcaaaaccttatttatataaaacaaaaaaaatcacctttggagacatcaactctttatagcactgtttccaagcaaatttaatttccaaagaaattaaagaaagaaatccaaacatattcaaaataatttttgaaagtccttttgtcccccagcataggtcagctggagaggacaaactaatctcctctgggtttctgcatgggcgattgttttactatggagttagtgttatcatctctgaatgtgtatttgtttgacattacagtcaatgatttgcaatgccagcatgaagtatctttaaaacactccctccttgtccttgttcacaagattgggaaacttattcgatgtggaacaaagtggatgaagcagactacaaatatatttgcaacttatgtgtctctcctttgccctgaccacccccaaaccctatctgcaactcctccccattttaaacttgcagtccaaagacgcacatgagaattgtttttcagtctttcttcaccagtatcatcccactttaagaataatttagctgcaagggaggaatttcttcatagtaagctttaaatcagcatttctgcttttaaccttttattccactttaccccattccacacatacagacacctgctcagagtaaaacacatcctcatgtgacaggtctgcattagctgaggctcatacatccagctatattaggtcctgcaatcttatcactaaattatacacattacactagcagcctgttggtaaagaaggttaaattaatttacattctgctcattatctggtgcttaaatgacgcattttatcccggagatttggcggagaatctccttctcagaccccacagcgtttcactgaagacaatgctcttacatttgtagtggtttttaatctgataagactctaatttgcttaagtcttttaaataagggttttaaatgtttctagccgttttcttattgaatttcctctaattcccccaagatcataaagtatatgtgtaaagtaaatatttcctcccattgcactgccagccgatgacctataactaagtcaataagaatccagctcttttctgctgaatgtgtttactaatcatattccagtttcttcttttaaacctcagaatagctgtggtccccacaataccatgccccttaaagcttcatttcatgaagggactccatcacattaaagaatgaaaaaaatctccactgtagttagtatacacagcccctcactccttgtttttcaagattcaaaccccagagctgcaaatatttttggaagcttgggtgttaatgccttattttagaaagccgagaagccccacagagccatatagatttctaaacccatctctcataaacccacagaattttgataaaagctctggtggctccactctaccgatggaactttcatcacgacaaatatacatgtatgaaggacctcaatcagcctccaaagtggttgaaaaacccaagggcacgtgactgctcctcatagtgccaacgtgtgcgagatgttggaagcactggggatcagcagcagcctagatgcctaaaaagataaggtgtcctaatttgtgtggacccattgaagtcaagtggtgaataaagacaattatctagataattcagattaaagtaaaagcaaaaccatatctatttgtatatatatattcacatccattttatattacagacacacacacgcacacacacactggctctgtaaacaactgactcaaagtgaggattttctttgcatttttccagcaggagtttcaacattctcctaatctcctaatcactttacacactcacagcagcggcgattgggtgacattcttctcaggccccctgtgtggcaggacaccaacatgataagtctgcatggggaaaaggaggtatgtggtgggaactaagaaacactgtccagtgaaaactctgtggcatggtggtggttgattttggagatttaatgtacataagacttgtgggtgcacaggcataggcagcatggatgagaaaggggccagaagaaaataaatcttatgcattttgtgattccagcattactgtgacctctggctaagttcttcttaattggttttagaaattactatgagttcagcctctaacacagaaatttccaatacggagaacattggtgggatcctggtagggaaactagaggtgctgcatggctcacgtggggcaaagaaggaaagcccagtgccggcgtgaggttttgagtctgggagacatcaggggttgtctcgattggggtttcttgcttattctttcaaagaaagaccctagaggagggaaatgtgtgacatggggtcagccgtgttttgtgctggtatttgccaccgattaccagtcttaaagtcttatttaatttcacactcttcagtgttagttgtgcaaagtccctctggccatggcagtgagcggttgggctgtgccgccaaactctccgtatcaatctggcctgggactcaaccaagtgatctctgacttttggaaagagtctgtcttcagagttcacccagaagatggcttaattagacatctccctgagctgttaggccttagacgggtgggagtcctgccctgcccaagctagctcaaggacgaggcccgcctggactcagcttggagccacgtgatgggcgtgagtgtgtgagctcctggtaaggcgcagaggtcagatggagaccttgcatcctgcccgagaagtgccccaccccctccaatatctggcttttctctgcatacaaaccaagctgaaaacagtccactacccaccacccctcatagctatggaaccaaataacccagaaattaaaagcttcactgtagctgtccttttccccatttcctaaatggaatttaaaaagctctggcttgtcaaaaggggaagattattttctgaattggaagtctgtagatatattgagcaacagccaccctctctgggtccctgcaaatggtacccatttttccaacccacagctctagctgctcaaccatttgagatttggggtaactacctgggggaacagtgttcagatggcagtgggagttaccacctcacagtggcctggggaagagaagagaaagagattagaggagggggcatttgctaaaatcactcaacgaacatgctgttaatgcttcctcacatttgcatgttactgccacagttttcctaggtgtcactgagtctccagaaagcaactacttgccgaactaagtaaaataaggagaatggtatagcacatgtgtttggagaaggggaaggaagggtggaatatgaaattgagcatagatatccaggtcaggaaagaaggaagtggcaaggggctaaatgaagtcccacccccccgccacttttttaaacaacagttggattaaacactcatctgtcttcctctttttctcttttcttccctctccagcttatgtccatctcccttttctatttcttttgctctcccttctttctgttttctctctcccagacatgctggtagctaacattcagcattagttgtcatggtgaccataaatcacctaaatccaaaaatacccacctataatctgagatgaagcttttatttccctagcgaaataatattttaaaagctgtcagctgacaaaaaaaaaggaacccacctcattgtagtaacccaagtaatatattacttctaaaggtttaaattaaaatgtcagcctgttaaaaacatgctggtagagtcttggacactcttcccgtcagatcctcacaaagaagttgactctgtcattcctggtcgctctttaacatacacacacaattctgtatgctctctccctttctattaatttcttcctcccctaccaactactttagttctcaaagactctacgcattgggttctaaaagaaaagaatctcctcctggatcagaaaacagcctcattggttgctgaagtgaaagatgtggggtttagggggaaaggttattaggaccataatggcggtggtggtaggaggtcatcctagaggagttaagaagaaaaaaaaatgcagggagaaggactggaggtggaaagacagagtaacagaaaactgagctgggtggtcaggtgctgcggtgaagtctagccccgaaatgataggtatatattctcccactcctgcctttttctcctctgagagaaaactttcctagtcagagaccctggggggtaggaggcgggcaaacgccgctgcagttgggccttttgtcttctaccttgggcttgttgtcttttgcctatcttggattacagggtattcgcctagatgaagagccattaattacccattcagtcaatattaggaagacgacaaagctttttacataggattaagaagacatcagattgttccattagtatattcctgctcacgaataagctttcgttatacatttccttttcccccgagccgctctaacaactgctgcatatattagcagcgggcggtgaggaataacagccgaaccagccttaagaaactttgtgtaccgagtcagcagcgaggaacgcgacctgtgaagaccacttttgcgggcagggatccgcagggactgactactttcggacaactggtacaatttcccctgggggtgaaaaaccacaacgcggcggggcacctttcaagtgagctgcagatttgattggcgcggggggtgggggaggggaggggagaatgggatggcggaggtcgggcggaggaaagaaaatggaaaactctccttacccctatttcgttgctttttcctcaagcctcatgcccccttcggcaagcacctgtcccttccgcgctagccacagctagagttctccacctttctctacacatccccttctttctgacaaggctcaggaccttggtcaccaccccacgcaccaccattttgcgttttgctagagacggtctgggctgatctcgctggtgtccatgttaggattaaaatcccttcatgacggcgaggaaaactgtattatttgctttcagggggtacattaggagtccacgtagtatatgctccgcaaacattcgctgattgaatgagaggcgcgggggcggggcggcggagaggggtctgcggccgccaaggccgccagggttaacccaggtccttcgaagaaggttgggaccgagctgctgccgcgtgtgaaggtgtgtgtcgcggctgggggtgccacaacgggccatggagcccacctcccagagggaggaagtctgtgcacaccagcgacttgggtcgaacactttcagcccatccactgggccaaagctatttaacaattaatgcgttcctgggggaggccgggggaagtacccgccccttgtcgggacgcaaagccaggcgtcaggtccaaaggggctgcagtgcagtccgatttcagcacggaacccagagccgccgccctgaaactttttaagccagtgacagaggagggtcagtccgtcctcctcctgagggtgaagaccattttatgagttcctttcaggacccccaaagcaagaaaagccaaagaaaggtctctttgctctagggggtcgttctcagctggcttctacaccatcttctgctagctgcgtccaccctctctcaaacctctggcttttaggggtctccagtcgctctcgtgctacccccgtttcggggttctatccaggctgggcatccgcccaatggataccaaggagaatgggactcactagggaaggaaggcagagcctggactgcttagaggtggactctgcctatacagaacgtttagtctttaacgaggacatggtatttttgggcggcgttgggggcagaggcggagagggtagcgtaatagactatcacggccttttgaagaagtcatatgtcattgtgaactttttttctctttaaaagcaaagaaaaactttaaaaaaacacaagaaataaatccttttgttttacaagcaggctgtggccaggactttggatattccataagttaacttaaaatcagggaaggataggtgctctatccttcagcagtgctatagctttgcccactcgtgtgatttttttttgtcgtctactagttccttaaaagccaattaaatcaagattttcagcatttcttcccattacatgccttttcttaattaatggcattaaacgtgtttaggcagcaatttttcttttcggtcaaaaagtagaaaaagacatattgagtgtaggggaagagcctttcacgtgcactaaaacaatgcgggcctgaaagtaatggttaagaaagcaatcattcattatttctagttctttatgtgctagttatcaaaagcgaacgaccaggggcgcctgcgcggcttgtgactggcgcaagcagaactcctctgctcttagccgtttcctgctcacctacgaggaccccatcctaccgtaggcttctccacctgtcctcagaatgcattccccatgtctaggaaacctggggtagggactgggggaaggagacattttgcgtctctctggctcccagcacaataagaaatgtcagcctcggcttggcgactgcgagcccgccccgcgcgaagcgagattggggagctcctctagtctggccggagccagggctgagcccgcgcaaagcattctccccagaagtcatcgctgctcttgatttttaaccatatcccaaacatactacggtctaataatttatttttactaccgattatcaaacagaagaagaatttaacacaatctaaatgacagaaatcacgcgacgttatctctgcattgcccccatttaaccccatggggttaatcccggacaagtgagcgtttaactggcccagcagggcgactggcggtgtagtgcagtgtccgggcgtgaagcactggatcgctttagacgcttcatttcaacaaatgatcattttctctcagattcacggggaaactccaatgcaagacctttgttttcttcttagtaatacggtttgtttttttgaccggggtcccaaatcgcccccctccatcccatattacatttgtattcttacactttaatccggaaagagggggttaggggccgagggctgtgggggggggggggctttatctgctcacattatcaaaggtcaatagcctcctaaggctaggcacttatttactacggagccaggaaaatagaggaacagtaaatttgaggggtttttttccatgtatttgaaaagaaaggcatcttccctcctccatcccttacacccccccctccgccccatagaacaagtttcaattcaggaaaggcctgtggcgtaggttggagactttttaactttttacataagcctgtagacctcctctggcaatgtccctcgattcctccagagtgaaaccagccaatcaagcaacgacatcgccaaaacccaaggcctggcaaccagtacttcaggcaggttcgcgtcgacaggggcaaacctccattctaccctgggctgctaagcacagtggctgccctccagctcttcagggatgttgtcggccccccgcccctcccccaaccagccaaagcaaaccttcgccaactcaagtttcccttgcttgcctcccgcgatgaaccgcgcacccacaagtctgggtggggcgtggctgagagcctgagtgactgagtgggccctggtggtgctgcgcgcagcgggatataacgagcgacagaggtcgctgttggaccacttttccacgccagcctagacgccgaggtttgctggagcgtgcgcaggggatcagaccacagggagcgagcgagagggagagagaggtgttgggtctcaggagtgcagtataatttggggaaaggaattaacgtccctgggacggctgcttcccgtcccacccagaggcggagtgtctaagttcaagcagcaggcgcgtcaggtctggcggcctcgccttcttgcgcttcgcccgaggcccagagtcccggaggcgggtgcccagcgcgcggcctgcgcttccctcccggccttaccattggcgccaggatgctgccgcgggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaaaggagccggggacgggaggagggggaggggcgaggcaggccggaggagaaagagggacaaagagcaaagacccagttagaggaaagagctgacggcatccccgtcccccggaccctctggcaacccggggcaggatggcgtactctttctgcgcctccccggttgccggcggttccagccgggaggagtaggctggggggcttcggtacacagcgcgccgctgcttcctagtccaccgccccgccacagggagaggccactggcgatttggttctgatttccttcctgcccaggctggcccctcggggaagcgcccctcgctggggcctcgccgcagggccagtgccctcttgccgccctcacgtggcgcggcctcccgtccgatgacccgggcaggagaagggggttcttacctaattgcacacacgccgacaccagtttgcggcagttggtctccattccccgttatctgcaaaacagaagagaaggaaggctgtaagaagcggcggccgtcgagtgagcagggctcagatgagactacgttacactagctgttaggcgcctactgtgtgctaggcttcaggcgtgtttttccgacctgacagcctctggctgtgcagcagcatctccagcctagcctcgggcccaggacatttatttatcaagaggggatctccctccagagttgccgcaaaagtgcccagaggttagaggactataaagccacagtgtgctggggaggctgtggacctactttcaagaatctcggtgccggggttaagaactcatctgaacgcaatggcagcgggagtgggtgggtggagaggacttttctctttgggaagctgtatgcaaagaccacccttcagtgcttgtccattagttggagctcggtaaacatttgtagaacatcagcgccaacgtgcccctgtcctagacagcagtttccctcggttttctgtaattctgaaacgaacgggctcttggcctagggtgtttcaggagcgagctgagttcgggcctctcatccatcaggagccacttttccatatttagccacactttctcctagagatactaacccggccatttatttacttactacaaataattaccctaaagtatgatttaagatcgcagaggagagacactgggtggactgagcgagactgaggagagcagggcaaacgttcttggagggtttactgcccgccaaggacggagaaatagctctggtataactgctacccagttctccccctttctctcccgggcgagccaaatctttttcacgttttcaaccacaacgcagcgagccaagcatttaacgcgctcccccttctctgccacaggcaagccgggagaggtgggtctcgaggggctccaccgggtgggtagaagagccgcggttgctttaaagacaagaaaagaaggtccagggctccctaggccccttcgatctcagcgcctgcctctctccacgctaaccagggtacgccgacgaccggagggcccacttcgcgcgggtgcggggatcggggtgggagcaagcgttgtcgggttggcggaggcacagaggcggggcagggagctgcgggcctgcctctggcctgagtaccgtttccctgcgtctcggcctctcctgaagggagctgggccctggggagcctctggccaaggtcgctgcctacaggaggggctgcccggcgctgtggcgtggggatccagggtggggacggccaggcggttcccccacccgctagcgagaacgcgggcggggactctgccgattcgatccttgtgggcccgtgggcccagaagtagcagtttggcggctccagatttagtgattctgcagtaaaatcacaggattagtccctgattgagatgtctgttcgtgagatattacaaaattcattatcacagctttctactaactcgatatgaagtaacacagatgggattttattagtccagacttcaaatgtttacttatgataatttcggaggaaatttgcatgtcatcatcatttcgataatcttttttttttatatgtctgaactggctgcattattagctggtagccggagcactgcagatggtaactgcaaatagtttttatttatttattttttttaaagaatgaaatatacaaaagaaaaagattgcgttgcttggtgtaaagtcagtcaattattacacattcttccccccacttccccgtgcttcagtgctgaagaccaaacaaagcaatacaaaacaaatcttcaagaactcatagagctccactctaaggactgaaaagaaggtcaaggcgtgttccttagctcactcctacatgtccttgtgacttggagatttattttgcagtcaaaatgagccttgagacttgcatttttatgcttcatttaatgaccaggcctactagaagaactgagtctaaataactggggaagataattttttaaaaagagacctccaattcccgcctgctgatccttaaacttgccctatcaagacaagtcttctgtgagaaatttggctgccagacttcggaactggcttcaatggctaatctcacaaattgagatgggagacttttcctgatgggaggtagttctcacccccaaagttcatgttctagttggaatgtatatgccaaggactcttgttttggccaacttgggttttatattgtgagcacacaaaaagcactacacggctaacggaggacgaggaaccatggcaaagcaggcaggcaagccctaagaaataaaacaatttgctaaaaaataatttctgatgactaccgcaagactgaaagtgcaggaaaaatacagttcgaataatcccagatcctttcacatttccccccttttcatacactttgttaccccataacaaaatctttaatggaaagtttaaaaataaacagcacaggaacatgtgttttaaatgaactaaattgtgaaattagccagtaaattaatttgtagtaagtaattatttaaggaaattaaaatactgctcagttcagttctgtattttaccatgtgtatgcgttctttacaaccaattaatataagtgctttaggaacatttgaagacaaacacgcttaacttaaggaacaaagcacctaaataatttaagtgtaattttgctgagttaaagtaaaacattccacaaatgaagtggctatttaattttttagggaaagtttggttattgaaatgttgtatgctcatgttacatcaacaaaaatcttcaatttattttgcttatgtgctttgttttcttgatattattggtatttgaattttagatggatttctgccaaaatgatattttgtgtgataaaagcatctttagttttgattgatagactaaaacaaatgcaaggaaatttctttaaatcagattaatttttcataaaaatattttagaatgtatgaattctgatatttacatttataatggtaaaagttttttccgtttagtttagtaagacaatactcacacaaaagagtaaaaaaaaatcacaccaccttatgatagtttgatttctaaattgcttaagaaagtaaagtggttaaactggaaaagaggaacatatttcggaggtttagaatcgaaaatttttttcttaatctccagctggaaaataattctctgcatccatttaaagtgtatctcctgaagtgccagattggagttgactggtgatcaatttaaaggagttacaatccaaagaaatggtgagagcttggcatccaggcctggctcccaggtaattcgcttgggcctgagaggtcactaactgccagttaagatggaatctttttcttttcttttttttcccaatggataacaatgggaagggggctaatcttccagtagctgaaactttgtacccagccctttatcttgagaatgctaatccttggcccgaggatttgttcctgcagtgttggcaccgagatttaagggaagatacctcgttttaaatgccagccacggtctggcttccctctcgacttcagcaccctgtagattgttagtgtctgtggcgggggacgaaaggaacagggctttgcaaggtctgtttgccgactgcgttaccttgggcgaaacttagccccaaaagccacaaatcacctacggtgaagattctccgaagtggaacaaatttccagactcgcattatctcacatccctgcgggatagatggcctccacttaccggctaccgggagagagctgctgtctccgcgtcccactgcttcccggggcgatttccagcgagccgagcctccggctgcacggcaagcgcccgaaagccgggcctgagaggactgcagggctcctgagggtgccaagttccgaaggagtccacgggtgcactggggcctccgaaatctagccgccactggcagtttctttctgctcctctccagctttctcgctcggtctcgcactctctctcctctccctccctctcatccctctctcttccctctgctcctactccgtgtggggagtgacgtgacgtcagcagagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagagcgaaaggagaggggacctggcggggcacttaggagccaaccgaggagcaggagcacggactcccactgtggaaaggaggaccagaagggaggatgggatggaagagaagaaaaagcaatctgcgccaacccggcagccctaataaatcaaagggggagcgccagggcagcggggagacagaaacgtacttttggggagcaaatcaggacgggctgggaggaagcgacagggaaagtggcccaagagacggaacaaaggacaatgttcatggggttgtttgggacgaggcgtgtggagtgtgggtgtgagcgtgcgtgtgtgaccttctttcaggcctgcagagttgaggaaagaggtcacagcaaagagggactgcggagggaggaaagtgagagaccggtagagggcgggagtggaggtgggcgcggtggggatgggagaggatgagtgaagagaaatctagaagaatggagtgagctagtgggagagggtgggagggccacagccgggagcgaacgagctaggcttgtcagctggggaaggccgggacgctgggcccagcttagctgggacaccgcgcccgaggtcaaggcgggtggaccaggcatgctgagagtgtcggcgcacaggtgggcacggccacgcactgacccagtgttcacgaagggtttgcactggacaaggctcagacgctcatagagtctagaatttcctctgctgtacctacattcaacaagttcaccctgggtcacggatatctcattttttaaaatgacgaggttaaggttcctggcgaggatggtattaaattgcacgggatagaagtgggggtgggggagagagtttccctcaagtccacatttgctcctgcaaagcaaagagtatgtgaaattacagggcatattctcactcgaaaagtgtgccttacttctgaaccctgattttctgatttcttgacttgagcaaagatgtgtattttggtagtgagcagaatattttggctctgtcctgcctctgagtggaaggactataaatataattcgcctggaggaccaggtgtgaaggcttctgccaggcatatgggacaatgttttttcaatctcaagggcatcctgttaatgtatgtttttggaaagtgccggaacacagccattgctcctggattcggattttcccaccaatattaattcctgcttgagagcaaaactcaggcccgctattaaaaagacatctctttggtccctaattgagaataaagttccctctaaaagttgtattgctcttcctaaatcaatataccaatactcgcaattttagaaatatatagtgactcgggagaatgtgcataaaatagatacgtttaaaaaagcttggcgcttaaaactaaccctagtcactatataggtgctgggctttccctacttttgggggctgtctggaacatgttatgtgttttcttgaattactccgtgttttgaattcatttgagttagcagtaaaaacaggcaaacaaacttgctcaatttgttttgagtgctaaatcccttcactttgaaatagctaacagtcgacagatggactcattttatggaaagggttagcctcttcagccacgaagaaaactgattagagatctacattttaagccatttctaacctccacgtaacatccgtgaaaactcaaactttctctctttacccagtggaaactcaaagcagtgttatttaaggggagagaaatgagggggaaaatgcccacgtgctgtttaattgtatttcctctctgactctgagaatttctatttctggtttttgaaatctcgccgaggcaagaaaatcaaatttcttcaacaagtcccacaactgaactctagttacaggacaccggaaagtgcagtccgagaaagacatcttcacctctgcccatcgacgatttttgcagcctccccattcctctgagtaatgggctaataatcctccctttttttcttttcattttgtagagattaagaggcgctcgtagcagaacggccttgccttcagctggtggcgaggataggcaatctcatggaaaagttggaagagaatgagaaaaccaaagacagaaagattcagagatccgcggagagacacagggagagggaagggagttgcgctgaaaagacgcaaagatacgcgcgtgcaactccctcccctttcaggtttcagaggtttgcaaaccagggctgagaggaaggggctcgggaagctcacgttcctctcgccccccttctgtctggagtctcgcccgccagaggctggttaaccccagtcccggccgccgcagacactgcgctgagcttttgggtcctcgccttgcccagcgccagtgcagctgaagtgagcagctggtgggaaatgcaaatggctcctggagaaatagaagatacagaatgattctcattccctcctcgagtgtgtggaaggagctggacatacgtttcacgctcctaatccttcttttacatttttagtcatactcctattaaacaactaattaatgcccagaatcaccagggaatacattaggcatgcaatcgtagaagcagggtgctggggggctacaaaccaccgagctgatttaagacgtggatttcaggtttttcccttgtcaaagcagtaaaggaagagcgggccttggcgactgtatttagattccgattacttcaaattagaagggggtggagggagcgtccaagcaaagcaagcaattctctgccctgcagatgtaaacaagattgtagcatcaaaggtactagctcctttagggctagatcgcctggactgggagcctggggaaggggagacactaaccttacgtatctgtgaatttcaaggatgttacatttttacataaacaactccagtgcggattctctggaatggggggagtaatacccccattctagaatattaaaacattttccccccaaagcgtatatcctttttatttcctcaaaattttgaactatgtctaaagataatagtcttccagtaaactggagcattggaccatttccttcaccctttcctaccgacattttgatgatctgattttaatgtgtggggggcacagggaattaaatacagcccataaaactaagcttagatgaaacagtgctggctaagtgggttcagataatttttaatgagaatctcaattacactcctccccccaatatgttgagacaagtgacagaaccgttagaatggtaatcaaattggaaagctcagggagaacaacaatttcgtgatcaaattggggcaaaaccgtggacaaatgtggggtgacctccgccaactccctgtcacccaagagtcaggatttgggaaaggtacagtattatttcagagcccgctgtgacgggctgtgtgctaccatttactttcttcactctggattatgatctcaaccctggcaagcaatttccccagctccttatctgacaacaagcgagtatgtaaataccaatggctagcgatgtttaactgcctcaaacattattgatttgttggctgttctaaattgtcttcctagtccaggtcttgtttccgaattgtctattctagaggtttgatccatgcctccgatgctacaatacaataattgtttttttaaaaaaggcatttaagatgaaccaattgatttgcatataaattaaaattactatgcgttgccgattccggtgttttataatcatttcgaaattagtacttaaccacttgagctaaaagaatatataaatgcctgtattgactcactaatgaattacccaattaaaacgtccgggcaatgctgggcgctggaaagattgttaaatcaagacatattacaggagggatatgaagattagaaaggtaacagaccaatatctcgcactcaaaacggagtttccggtgattcccagctttaattttggagcaggggtctttctcctctgctgttaaaaagattttgtgcttgtttgtgagtgagtgcattcaagtggaaggaacgctcccacggctacggtggctcaggccctttgctcggaccgggaccttacagttctaacccaggagcgttaaactctggaagactccgggccagccctggaggtgcgtggccccgcaagtcgccaggccaagcttgctttttctgtctgcccctccggcaggctgggcgcgctatggcagtgagctttccgcgcaaacggagagctggaaccaaagctgacatttaatagatatgctaactgagcacttaccttcgtcctgagaataggaataaaaggtagctcttcttaagagaggcggtgcaaaggcacgctataggagttcagaaaaggctggcggcgggaaatctgtagcctgggggctagtcaacatcccctttcatttcaagcacttattgatttgctgttgtcatctttggcgacgcagaaggacacttgaaagaatttctgatggggctctgatctgagaaaggaggtgacctgcccaggctcccaccaaattcttaattaccacatcaactgcttttttttatcccccacccgacctccttccttttgcttattcttaactttttaattattcagaaactcccttacctctcagtggcttcccttctgcagcagttttctattcgaaccttttccccgcctttccgtggtagggcctgtatattgatccctctgacctttggcacatctgggccctctgaaatctctcaatcttttcagatttgaggatggcaggctccaccctctccactgtgtgcacacactcagagatatgaaaacttacacagactgccttcaaacccagggtatctaacagatgttccctttccagttcgtctcttgatctgaaatgcctgcctgattccaacttggataccactctttcttgcccttcctttttcaaagcagtttggacatgtgtgcaagtgagcccagaacagctccacccatattctttaccaaactgtaaataaaagaagaactaatgaagtagattggcatatagattgcatcaagagcccgaatccccagtttctggattccccattcaactctggctgtcatctacattgacagagtcattctaagcagaggcccagagaaacctgcattgtgggacaacaggtaaagccacagtaaaaagtggaataattttaaagtcattttattagaatgtaaattgtatttctgggttttgttcgtaaccacctagttttaatatatacagagttagacaggaaaaaataggtcaacacagttattggtactagagaagacaaattccatgggctcctcagtgaaaagaagatccccaaagtctataatttttgatcatttaatttcatttataattgtgggaatgaataagacaccaactgctttatgtatttcatttacatcaaccaatttgtgtttccatcaaaagcagttatacagaatttcttttaacttctggtagcaagttcagaaaatgaagcttacagccaccctgaactggatacatctcttgagctgaccatttctgtaagtgcaggaatataatattgttcttctatggtctttttgcactcttttagggtttgcaagtccttatcaggtctgacatcactgtttgggtctacattcattacaagcaaatttgattactatgctgattttaaaacagcctatttggccagcataatcttagttttcaaattataaaaaccttttaatatacgaagttcccagtttttacctcctctagctccttgctcattcaaaacttctattttaattggtgtaagtaataataatttgtattactatttgtactccttttacttttttggagattgggctggattccagagagaacaccagcatcaccaccaccacaaacaacaaaatctaaaagtaaagcccttatttgcatgataattggtacttggaatgcttctgacttactcaatgccaccttataaaggtaccttgtaaactttcttggaatttctagcaagagcttgtagtaactggaacaactctctgggaagatatcctctttgatgggctttcagtttctggaggaatagattgagagcaattagggagggaggggacattggaaattggcagctacgtcagctgaaacaagcctgggttcagtaaggtgactgatgttgtggttgattccctaccccgagtttctctttaattggggcactgactcttcccactttgggatcccaaggcactcggtgtgtatgcagattcctcccttgtggtcttcaccatgtggtttcgtagcaggtctctggttcaatgatattttatagtcatagccctcatattcattatcatgatctcaatgtttaggcttttagtgtatttatattaaacctgctttattagtaagctggagcacacaggagagatgggggcaagtaaggactcagcagagctcaaattcagacatgtttaaatggctttgactgtgtaaagtgtggcaatgcttcctgctgccctagctttccactctaagcttcacatgtcctctggctaatgaagtgtgatataggccacatgctaggaataatagtatttgttgagaacaaagtgaactcaggaaacctggtatacacaaaatgcatc

SEQ ID NO: 1131 - DNA, 8252 bp, Homo Sapiens
gccatcgtggctgggccataggctcactgctctgtggtagatggaagatatgggccttggtaatatactgaaatgccacaggaaaccaaaccagaagtgatttaacccacaagcacacttaggtttatttaacatgatgtctcaaggtgggtggggggctcaaatcagtagctcagggttattaaggctctaggtcttgggccttacctcattattacataatggctgcctgcaacaccacatcacacccaccttccacaacacccaaaggcaggctgcaagggctggcctaggaagccagagggcgctcttcattcatcaagggagaagcctgccccaccttcaaggagatgccccctatgtctcatgggccacatagaattgcacggccacttctggctaaaagaggggctgggaaagtgaattctttctcccccttccttcgtagagtgcaagttaggtaagaaagaacggatggtggacagccaggaaacagtcagctacgagatgttgtgtggaaagcccacctttctgacactggagaactgtgggaagaacggacaggccacacaccagctgggctctgagaacccccagcttctgctccacagtgagccagcaggaatccaaagggcatgggcagaccccaggggctccttcaccccacccaggggtagagagggcaagacggagtagagcgaggtaagagactgagcaatgcgttcccaaagactgtgactgacagaagctgtgcaaattattatgacaaactgaattttaagaggaattggactaaataaagttagctcatttttacctgtaattagcagacagagagtgtaagatcagacataccatagatggaaaagaaaagctaaaacttccttgcacatctgagaggtaagaggaggtgtctgtggcccccctgacacatacgtgacatatgtattattacggctcatgtgtgtgctgctgtgtgcagggggcagggggcttcccgttcctgatggttcttcttggtgggtgtctcccggcctctcaggcctctttatctgctgaacgtggtagccaagggtttgggaatgatttgccagactggttaatgtggaaagagctggccccgctcagttctgcacctccctcttcctccctggaaccgtctggctgcagagagcaggagctttccagagctcccgggggatcccatctccagtataactgtgcaacgtgtgcccagcacaagagcaccagatggagggacaggtgggaggaggaggaacccagggtgcatttagcttggggcttgctgagctgaggtccccagagcaaggacgactaggttggggggacaccctctcccaatccttgccaagctacagaggggccagtgggaataaagtgacattttggcttctgtatccctcctctgctgttctattttctagttcgttcagatctgaggttggggaggggttttcctggaggggtcagtccatgccaccctctgcaatttttattacacatgctttcagacattctgctacaggtttcatctcctacgccaatttctatttgggaaagcaaataaacggaaagctaacttgtgtcacttggtcgctggggcatccgcagtgagtagttaagaaatgccaggggagtcggtgtccattttcatgcctggacaagagtgcgtcttggacttgcgtcctgctgcacaccccaccgtcccgctgcacaccccaccgtcctactgcacaccccactgtcctactgtacaccccaccgtcctactgcacaccccactgtcctactgcacaccccactgtcctactgtacaccccaccatccctgctttctgcactcagctgcccacttgtatcccagctcaggaagcccagaagatgcagaacctctgcgagagcccagggtgaaacgctgcgcttcactttcaaagaaaggaaaatcattcatattctttaaaagaatgaacagcacagattaatatcgatctcttttaatttttaggccaattttgagtagtcaaagtcagagcagtcaatctgtgttgtgagccgaggcacagctgcagaagcgtgtctgaggtgtccggtggaggtggcagccgagctctgggactaatcaccgtgctggggacggcaccgcgtcaggatgcaggcagatccctgcagaagtgtctaaaattcacactcctctacaggggtgagggggagggagaaagagatgctttagtgaggataaacattttctttcacatttaaacaattacagagtttttactttaaagtatccataggcacattctttagaaaacatgaactgtcagccgggcacggtggctcacgcctgtaatcccagctctctgggaggctgaggcgggcagatcacctgaggtcaagagttcaagaccggtctggccaacatggtgaaaccccgtctatactaaaaatacaaaaaaaatttagctgggcgtagtggcacacacctgtaatctcagctactaggaagctgaggttgaactcaggaggcagagattgcagtgagccaagatcgcaccattgcactccagctcaggggcaacggagcgagactccatttcaaaaaaaaaaaaaaaaaaagaatacatgaaatgtcttcagatttcgtcatgccttccccctctatcctaggcaagctagaaagcgttaccaacagtggctcttcccaggcttttggttagagatgtgaagagaagccggggggaaatcaggtttcttcccaagtcccttagccctgcctttctattcctggacctgaatgcagcctgactcaggctaccccattgcaccaccactggcggccgtgactctgtgtaaaggcatagctggtgatgctgatcagagcctctgtagtcttaaatgacttttctaactaattctaaatcttcagaacccatcgtataaaaaggccataccttctggagggacgtcgatggtattaggatagaagcaccaggggaccccacgaacggtgtcgtcgaaacagcagcccttatttgcacactgggagggcgtgacaccaggaaaaccacaattctgtctttcacggggggccactgtacacgtctctgaaagtgcacaggtaagaagcaaagtaagttgtgggctgaattccttgatgttatcatgcacacacccatccagcttccttctccaatgacatcagcaactgtccagtgaggcggatataaaaccctcaggacatgagagggagacgtggtcctcacatcctgatgtgcaaacattacgctcagggaaaatgcaaggtgccccaggtttgtggactttgcatctttctaggtaacttatttattcactttttaatttcaacaaatgattattaaattttactcaatacataaatatttactgagcaccatttgtgtgcatgagaagtgggagctagcatggcaaaagccaggcactgtgccaggtgagagagacccagaaattaaaaccagagaagtcattaataagagtctaaatatctgggcccaggctcatgcctgtaatcccagcactttgggaggctgaaggaggtgaatcacttgaggtcaggagttcaagaccagcctgaccaaaatggtgaagccccatctctactaaaaatacaaaaaattaggcgggcattgtggcacacgtctgtaatcccagctacttgggaggctgaggcaggagaatcacttgaacccaggaggcagaggttgtagtgagccaagatcgcaccattgcactccagcctgagtgacagagcaagactccatctcaaaaaaaaaaaaaaaagagtctaaggatctgatggaggagaaaggcaagaacatgtgcgagacaacgcaaggccatcgtcccagggtgcccagggtaaccacgggggtagggcactccccggagaggccaatgacaagcaggttgaacaaagcaggggggctccctgcaggaggaggttcaccaggtgaagatggagccgcatgggcaaaggccattccagagacccaggtgtgttcaggaggtggaaacccattgcaggtaaggtgagaggaccgggtggggtggtctaggaggagccgacagagggtacaagctgtgaaacagcttgaagcagggcagtgaggaaagggatctagaggaggaagacacgtggacagatggggctggctgggggctgccgcaggatcttatgcaagaggttctaacaccagagcttcaggctctgagctccgcggaatcaaaggtctcagaaagcaacctattaggatctggtggttgacagcctgcagcagggggtgaaagaggagcccagagcaccctccggtccctgtccctgccttggggcataggaggggaggaactcagtctggccacactggctcaggtgagggcgccccaggggaggccgagaggggctgttctcttgtctgctttgctatcagggactgcctcgagatgtctttggagaaagtgttcctggcttgctgggaaggatccgtgttcagctcccgctgcccagcagcttccatgggaaccttgccctcctggggtctggatccatcgcgacgtgaaggtgatcatcgcccacccccgggacactgtgggggtcaagagaggccccgtggtgagggaggatcatcatcctgggggtcgggggggtttcctcctcagggaggaagatttccagccccggtgctctgcctccggcagactctgtcttgcccacccgctttgtctttgtcgcatgatggaaataaatggaaatggtttccacacacgaatgcactaaactgtaatcacaattttctagatttcagttgtaacaggatcatggacctgagtgacccgcaaagacgctctgagccttgagccagagggtgtgtggggtggggaggggagtttgccacggcctctgtgatcccacagcacagggggcagagctgggggctggggtgggggcaagggcgcaggcagatgggcctgggggtggccagcacggggacccacccagttcgttctgtacaccgaggccacttcctctctcgggttccaaagctcccccgctccctgccatgggcttgggggtcttcccactgcagcccaatgctggctgctcttctacgctgcccaagcccacccctcaggcccggtaccccacagcagagatcaagaggtggctggagggcagtgggggcacggacagcaccactgggcgctccctcttcaggcctctctggaaacccttgctttggaaacgtagaaagccctttctcctgcccccaccttgaaactgtacctaataacggcaaataagttattcagctccccacagctggcaaagtgcaagtcgcagatgctgccacacagcatttcctgacagccctagggcagaccgttgatccattctgcaggtaaaggagttgagatgcaaacacttcccaaggaagcaagaatggcctcctcctccactccctagaaggacccagggcaaccgatccacttgacaacaccagggaatatgggttgccagccacgcactcatgagagaggtggctttgactcccagagcatggatcccaggggagcccaggaacctgtaggagagggtctcccagttggccaccactgggacgggcattcgggcctgtgggagagggtctcccaggtggccatcactgggaccggcatttgggcctatctggatgggccttgggagggtctgcccctgggggagatgttggcatgaacagtcaaaagcactattctgagaccccacgccaacacttcctctttgaaacatgacacttgggaggattgtatagtcttcctaacacaggaaaacagccccgactgaaggcagccccctcctcgtcgcacttctcgaaggtctccgggggccctgccaccctgagttactctccacctgcttttgccgatcctgtaaattggatatacttttaagggcctagaacagcacctggcacaaaacaggtgctcaaaaatatgtatgtaaaacagtggctcctggcggaggctgccagagctggctgtggccccacagagcaggaagaagcacgccttacctgtctgggcctcggccagggtgccgagggccagcatggacaccaggaccagggcgcagatcaccttgttctccatggtggccattgcctcctctctgctccaaaggcgaccccgagtcagggatgagaggccgcccgagccccggattttatagggcaggctctgtttgcttaaagagcgttagataacatttgcctaaggaggcccggggatcctctgagacaataatctccactgatttttatcaaaggtgtttcctagacatggtcaagctacatggaaggatttgctgatagacagagacgacatgtggtgaggtcatcttggctgagggatctgagattcagaaagtccctctttcccatgggagtctcctccaacctgaccttaatccaggtcctactcatatctgagaggccctcccgccagggtaaatactgtactcactgcagaagtgattcatagtgagagatggccggaaaaaggcttggccgtgacaacagtggctcacggggtggccaccgtgaccttgcagggggaagggaaggagctcatgaagcccattccgtctaggcctaagctaattcttttacagtggaattgttttaataatgaaattgtaggcctggcgcagtggctcacgcctgtaatcccaacactttgggaggccaaagcaggcggatcacttaaagtcaggagtttgagactagcctggccaacatggcgaaaccccgtctctacaaaaaaaaaaaatacaaaaattagccaggcatggtggcgggtgcctgtaatcctagctactctggaggttaagtcaggagaatcacttgaacctgggaggcggaggttgcagtgagtcgagatcaccctactgcactccagcctgagcgacagattaagtctccttctgggaggggctgggggcaggagggagaaaaaaatagtatatacgagctgccatcaaaaactgacaaagtgaacgtggttcactcccctgtgtctatggggctccctccctccccctcccacaccttcccagttggtcccctggactcctgtattttagaggacagcctcctgctctcctgtaccatgcctcactcccctcccctgctcggagctttctctttcatagctcttattacctcctggtggataaaacaagtgactgacacattatgttggttatttattcattgcactcctccctgcagcagacgggagggcgcatgggagcagaagtcctcatctcctagtgccttgaggtggccccagaccctagaacagtggctttgattggcattcgagaaacagctgttgaagagctgcatgaagaaatggacaacaggagaaatcttttcttcttcagtgagaaattaggccctgaggaaaatgcatgctagcctaacaaaggtactatcttttcttgggtgacctagtcagtacatttctgcagcccctctgggaggggagcctgggccagaatgggggcggccatgttcctcttcgctccatcccaggacccagcccctcctccagggctgccactcctgcaccggggtctccactcctgggccagggtctccaggaggggcctgaccgcaggacccagggaggggccgaggcctggtgtcctctgtggtcagcttaagtttattgaaaacaggacgggggcaccaggcccagggtggtgctcatagtgacggtggttttcgctgctctaatttctcggatcaaaatgggggctcttggaaatgggatgtaaattgcacaatcatttggagaaaaggtgggcagtgttcggtgaggtttaagccatacagattttacagctcagcaaattcttctgtttccaggcctggtctcttaatcccagaaacatgttcatacttgggcagaagaaaacacaggcaaagatattctttttagcattgtttgtaacagctggaaacagggaaagaaggaaggaaggaaaggagggaaagaaaagcaaaataaatattcattaaccagggaaagggaaaatgaacttaaaatacaatgcagtcgtcccttagtacccctgggggactggtttcaggaccccccacccagggatgccaaaatccacaaatgctcaagtcc

SEQ ID NO: 1132 - DNA, 28536 bp, Artificial Sequence
  chemically treated genomic DNA (Homo sapiens)
gttttgggagttaggtttttttcgttggatgggaaaaggaggtgcggaaaggggtaggcggtttgcgggttagcggggatgagagttgtggggagaacggaggagagagtaaaattattttttttggaagtttaagggaagggagttgaggtgagagaaatggttttttttaggttttaagttttcgtttttagtttgtattatttaagtcggggaagtgataattttttttaaatttcgatttttattttttgttttttgtagattgattgatgttttcgcgttgttttagtttagtaattaaattaggtcgaggtatattttttttatttagagtttttaaattatttattaatttgtaggagatttaaatttttcgggtaggtttcgttagcgtttttagtttttatttttaaatttttttttttagttttttttttttttttcgttttttggtttttttcgttttttattaggttgagaggcggagaggtcgggatcgttgggttttgcggttttagaagttaaagttcgttcgtggggatcgtttttttttttattgtttttaagtgaataatatggtgggaggtgattttcgtttaaagggtttttatttgttttttattgttgcgtgattttttcgtaagtcggaggtagagttttaaaaagaaagaaagtgtgcgttgagtattgattttaaatcggggatattatttgcgatttttttaagtggtagtagtagttttttgtagaataaagatttagtgttcgagttttaaaagtttttaggtaaagttttatttagatgaaagtaattaaggcgaaaaaataatgatattgtcggttttagaaaatcggcggttattttttgttttaagttttttagcgtggtgtttgttttcgtttattttggttgtgcggggggttgataagtataataaaagattttagtatatttttttttttatttttataacgatttttttagcgttatgaggatgaattttttgggattaagtggtatttgtttttatttgttatgaaattaaattttatatttttttaaagttgaaaatcgcggataaagaaggatcgggtgtttaaagtttatttaaatatttatatcgaatttattttttgtttagatgttagaggatggtagggagggttagggttgtaatttattttgatttgttttattgttttgtagtttgtaaattataattttgtataattttaggaataagtaggtttagaattaatgggttaatattatttaaaataaaatatcgggagtatgatttttgttttaattatatattgttcgataagatttaggaaattttattttaattttttaatttttgagttttttgagaaattgaagggttgtagttattagaaattatttttgttttttttaatgtttttaaaggatttggaaatagtaatgtaatataatatgaaggatttttttatttaagtttgaagataaacgtggaagtttaaatattttgaattggagatgtttttttgtaaatttattatagatgtattttttttgagagaaatgtatataaattatatatgtatatatgtataaatatttttttagaataatttgttagaggtgtaggttttttcgtaaaggagtaaatttgagagttattttaagttgatggatttgttaaattttttttttttttttttttttttatattatttgttagttataatggaattttttaggtttaagttaaagaaaaattggagagataaaattagattttgtagtttttttttttttcgggaatgtttttttttttttttttagtttttgatgaatggttattatttatttttattaaatttaaataaggattgttgttttgtatgtttaattaggtaggtagagggaattggtttgtttaggaagtagtgattgagatgttttggttaagttagtgatagaggaggggagaaagaatttagattaatttgtatgtagtatattttatttttatgaaataaaatatatttgttttatatttgttgaaaagtaaaataataatattgtacgaaatgttatatatagggtaggttgtatatagtagttttagaaatattattgtatttattagagaaattattttaaaattgatatttatatattttttataataataataatatgttagaaatatatagtgtggtatttagtatatatatttttttgttcgtaagcgaaaaattttaatcgtttttgtataatatgttttattttaaagtttaatttttaaaaatattgttgtgatattattaataattgtttttataaaattaatttgatatttcgatatatatatatttttttagttatttaaatgttaataatgttaaatttaaaaaataataagtttatagtaatgttaaaatgttatatttagttaaatatttgtttgtgtatgtgtttttgtaattgttagaaatatttgtagtgaaagatgttagatattgaggatatttttttgaaattaaaggagttttttttttgatttagtggtttttttttttttatatagtttttttttttttttttttttttagtgtttacgattttttagtataatttttagttttttaagggcggagttgttttattcggtaaggttttaggatttcggcgttgtgggtgcggtttatacgggtcggtttattgtatattggtaagtatttaggttggaggtcgggttttgtacgttggcgtagtcgaagttggagtgttgttttgtttttagttttaggttggttaggttcgagttatacgtgtttttataaatatacggaggagtcggcggcgcgtaaggataggtaggcgtcggtatcgcggaatttagcgacgggttatttaggttgtttaagttatttaggttgttgagattggagttcgggacgtttgttattgttgagggtattatgttggacgatatgtttatggacgagatagagttgggtggggaaaatatgttttgtgatgatagggggttgacgtttatagagttgaagaaggggaagtttttggtggatagggaggcggatgtaaggtttttggcggtttagttgttgtaggaatagtttgggtatatgtcgtcgtagggttgtatgagtttattgaattgcggttcgaagttatttttgtatagttcggtttgttggttgcgttttttttttttttatttggttcgacgatttttgaattaaatttgggggcggttggggtaagggagtaaatagatgttatagtgtagattattaaaatttttatcggaggttaattttcgttttttttcgatatatacgttagcgtatttatatattttggtttcgttttattgtatcgttttgtatattaagatattagggttagtttttagttattggttcgggtttttattaagcgtaggagatttggtttgttttggtttgcgagttgggattcggagttacgttataaattttagtcgaacgtatggagatttgcggacggtttgattatttagttaggcgtttttttaggtttaaaaatatttaatgtaaaataaacgcggggtagtaggtttttttaatttttttcggggtattttgtaaatttgtttttattttaaagttatagatttacggatgaggagaaggggttggaagggtattagaggatcgtttttttttttacgtaattttttttttttttttttgatttttattgtcgttttttattttttggtacgtgtttttttaatagggattaggtcgttaatattttttttcgtttagtaaaataattaaataaagagtaaaagattattttttcgttagttcgttaattttaggagtttggtatattaaatttcgggaattcggaaagggtagttttggagatttttttttttttcgttttgttttttttttattttaagtttattataggtttgttcgcgcgttaggtttagtcgggtcgtttggttttgtaggcggttatttaggtcggtcggtttttattcgtgttcggtggtttagtcgtaatttcgattttaatttatatcgggtttttttgtcgttttagacggcggtttttgtgtattggagagaggtttggtttgagatattcgagttgatattagtgatgttttatattatatattttcgtcgggtttagtcgtgtaattcgttttttttttttttttttttatttttgattttttttttatttttttttttttttgtattcgattgttataaaaagtacgttttatttttatttggttcgataagtagtcgttttggaaggagaggtagttgtaaggagagtttagcgtcgcggttataaagtattagggtggagttgcggaatagcgggcggggtgggagggcgttttcgaaggattttagaaaatttatagattttgtttttaattatttgttatttttattttaggttatttaaattttgtttaggcgagaagagtacgtgagaggttcgtttttttgatgtgtaagagagttaatgaaagattgattttgtttaaaattacgtcgtttaggatttagttttggttttggatagttaaattaaaattatttttaattttttttcggttttttatttattagtatagttttatgttttgtataaatgttatttagagagtgtttttattttttttgatttgggagagtattttggtttttattttttttatcgttgtttttttttttttgtttgttttgttttaatcgggggttttattttttttatttagagtatttaattttttttttttaatagtaaagtttttggatgtcgtttgatttgtttgattttgttttttgtttttagaattttaataaatttggaattttttatcgattagtataaattaggacgttgttattgggttatttatttgagtttatttttgttaatttataaagtatagatttgttataaagttaaggtaagttttttttataaaattatgattataatttagaagagggggtgtgagttttaatttttagagtttaatttttgagagaagataaataaattaagtagaaaagttttttttttttttttttttttttttttaagaggattagtagttgtgtattaaaattttgttttcggagattataaaattaggaaatagggtgtgtgggagagatttgaatggtcgaaataatcgtaaagaaggtgtaagaagcgcgagtttaggagggaaaaagttgggttagggtcgggataaaggttttttagggagggttaattttttcgtgtttttggcgggttttttttgttaaaggtttataggttggagtttgttcgcggtttttggtttggtagggattttattagttttgttttggtaattgtaagttaggaatataatgttttgtgtaggggattgtttatgtagtttagttcgtgagatcgcgggatggcggggtagtgagtcggtgtcgttttgggagtttgagttagggcggtagttttgtcggtttcggagagggaattgtaatttcgtaattaggtcgtcgcgaggttttttgtttttgtaaagttgcgttttatcggcgtttttttaggcggcgttgttttttatatttttttttggtttatttggtttgtatttttataatattttttttttattttttttagatttcgtgttggtttttattcggattcgggttttcgtaaggttggtttatatagcgattttttcgcgtgtggatatgttcgggtagcggtttttttggaaagtggtttttagtttttggagttgttggttggtaaagtgagttcgttgtcgtttttgtcgtttttttttagacgggttttcggcgtttacgtttttattttttttttgttggtttttatttttttttgaaaacgaaatatatatattttttcgttagtatgtttatttgtaacgcggacgttaattggatcggcggtagaagtcgtggaagagttgggttgtttggcgtcggaggagggtgcgcgcggcggtttcgggtcgcgaggagcgttgcgtttgtggggtgtgtaggcgtaagtgtgggtgttcgcgttttattttttttttttttttagcgtcgtacgttttatttatatgtttattttattgtagcggtatatttatttttatagtttgtgtttttaagtatatttatatatttttgcgtagatatattaaattttttgggacgcgtatacgcgcgtggtttatagatttttttttttttcgtagaaagtttagatttttatgcggtttgggaaggttaggaaaagatgtggggattcggttgggtatcgaagttcgtcggtttttttttaaaaaaaaaaaaaaaatgttttttcgcgaagggtatttttgagtggttttaggtaattttttaacgagtggagtttttcgggagttgaaagtcgagaggaaaatagggatagaggtcggcggtttttgaaggttttcgaattaagatgttgggatttttgtgatttaggaaatagaagggaggttagggtacgaatagagagggcggtagaattgttcgcgtttttagcgttttaggagtcgggtcggtcgagggagaattaaagggatgcggggtagttaaaatttcggttttcggaagttttgcggggagttaggcgaacgattatttttattacgttttttttcggaggggttgatttttttggggcgagagggagcgggtggcgtagagtagttgagcgggaatgtttgtagggcggcgcggcgttttatttgcggttttcgggttggaggtgtcggagatggtgtgtatttttagtttgtgtttggaggagtttagcgatcggggttgatcgggagttagaatcgaagttatggttaacggttggggatggtgataggaagatgaggagacggtcgatagtttggttttcgttgttcggtgttttaagtgaagcgggttttttatgtagtttatggacgagggagcgcgacgttttattagtttttggttattgtttcgtcgagttttcgtagtcgtcgttgttcgtttcgggtcgcgttttaggcgcggagttttttcgttgcggggagagttaggggacgtaattttcgtcgagtttttaagttaagttgttttcgtttttttcggaaggtttaagcgaaaaagttcggagacggaaagttagcgggtaaacgaagatatgggatgtgggtagaagggtattatttagagcgtttttagggagtaggtttttaagttttaaagcgaaataagagtgggtaaagatttttttttttttttttttttttttttaagaatttttttaataaggaaagttaacgtcgatcgcgttttgttcgttttttttttacgcggtagttttgatagagaagtgttaagagtgatagggataggtaggtgatattagattttttgcggcggtagtagtcgttgtagttacgacgcggttttttgagcgtatttttcgtaacgcgtatacgtatatttttcgggcggtcgaataggagtcgggttttgtcgtagtttagttttaggtatttaggcgagcgacggattagatttgcggtttcgcgtttttttgttggtttaatattttaaaattagaggcgggttttttggtgtcgagacgttatttcgtcgcggttttttttagtttttttcgttttcgtttttttttagattttttttcgggtgcgattgacgtggtttcgtattaattaggacgtttcgagtcgcggtggagggattgttttgtttgtatttattagtagtgcggggtcgggttattgtttcgtcgtgcgtattgggtttatataggtaagttttcgggaatttagtttttgtttagtttaaggcgattcggtttttagtacgaatttaaaggtgaagagatgaggttaggagtcgaaggtttgggagaagagagtggaatggttaagaagagaaaggtataaggattaataagatatttattttttgtgttttattatatttatttttaattttttattttatataaaaaggagatacgttatttaaaattagaaaatttgaaaaatagtaataaattattttttcgattttaaattttttaaatagtttgttaagtgaatgttgcgttaatttgaagaagttttaattgtaaagaagatagagttttgaaaaggtaggttaataaattagaaatcgagaagtaaatggattcgttaaaagaaaattattttgattttaaacgaataattgtttggtggtttattttggatttatataagaataaaaagtcgttttagattacgttttttgtgatgtttattagtttttagatagaaaatatataatagaagagaaattttaatttagcgtttttaaaatgttgaaagtttatttattttatttaacgttgattaagatatatattttagattttttaaattttttgtatattgtattaagttcgttttaattcgagagagttacgttttaaattcgatttttttgtttattttattattaattagatttaaatttataaagtttgtagaattaataattttgagttaattatatatgaaatatgttttaatgaatttttatataattaagaatgttgttaaataattaattttaaggataatttttaatagttattttttttttttagtgagtttaaggttgttttgagttattaaagtttaagtaggtagaaggggtgtgtgtgagttaagggcgaaaagtttagaattgcgtttaattagtaaaagtaaaattttatttatataaaataaaaaaaattatttttggagatattaattttttatagtattgtttttaagtaaatttaatttttaaagaaattaaagaaagaaatttaaatatatttaaaataatttttgaaagtttttttgttttttagtataggttagttggagaggataaattaattttttttgggtttttgtatgggcgattgttttattatggagttagtgttattatttttgaatgtgtatttgtttgatattatagttaatgatttgtaatgttagtatgaagtatttttaaaatattttttttttgtttttgtttataagattgggaaatttattcgatgtggaataaagtggatgaagtagattataaatatatttgtaatttatgtgttttttttttgttttgattatttttaaattttatttgtaatttttttttattttaaatttgtagtttaaagacgtatatgagaattgttttttagtttttttttattagtattattttattttaagaataatttagttgtaagggaggaatttttttatagtaagttttaaattagtatttttgtttttaattttttattttattttattttattttatatatatagatatttgtttagagtaaaatatatttttatgtgataggtttgtattagttgaggtttatatatttagttatattaggttttgtaattttattattaaattatatatattatattagtagtttgttggtaaagaaggttaaattaatttatattttgtttattatttggtgtttaaatgacgtattttatttcggagatttggcggagaattttttttttagattttatagcgttttattgaagataatgtttttatatttgtagtggtttttaatttgataagattttaatttgtttaagttttttaaataagggttttaaatgtttttagtcgtttttttattgaattttttttaatttttttaagattataaagtatatgtgtaaagtaaatatttttttttattgtattgttagtcgatgatttataattaagttaataagaatttagtttttttttgttgaatgtgtttattaattatattttagtttttttttttaaattttagaatagttgtggtttttataatattatgttttttaaagttttattttatgaagggattttattatattaaagaatgaaaaaaatttttattgtagttagtatatatagttttttattttttgttttttaagatttaaattttagagttgtaaatatttttggaagtttgggtgttaatgttttattttagaaagtcgagaagttttatagagttatatagatttttaaatttattttttataaatttatagaattttgataaaagttttggtggttttattttatcgatggaatttttattacgataaatatatatgtatgaaggattttaattagtttttaaagtggttgaaaaatttaagggtacgtgattgttttttatagtgttaacgtgtgcgagatgttggaagtattggggattagtagtagtttagatgtttaaaaagataaggtgttttaatttgtgtggatttattgaagttaagtggtgaataaagataattatttagataatttagattaaagtaaaagtaaaattatatttatttgtatatatatatttatatttattttatattatagatatatatacgtatatatatattggttttgtaaataattgatttaaagtgaggattttttttgtatttttttagtaggagttttaatatttttttaattttttaattattttatatatttatagtagcggcgattgggtgatattttttttaggttttttgtgtggtaggatattaatatgataagtttgtatggggaaaaggaggtatgtggtgggaattaagaaatattgtttagtgaaaattttgtggtatggtggtggttgattttggagatttaatgtatataagatttgtgggtgtataggtataggtagtatggatgagaaaggggttagaagaaaataaattttatgtattttgtgattttagtattattgtgatttttggttaagttttttttaattggttttagaaattattatgagtttagtttttaatatagaaatttttaatacggagaatattggtgggattttggtagggaaattagaggtgttgtatggtttacgtggggtaaagaaggaaagtttagtgtcggcgtgaggttttgagtttgggagatattaggggttgtttcgattggggttttttgtttatttttttaaagaaagattttagaggagggaaatgtgtgatatggggttagtcgtgttttgtgttggtatttgttatcgattattagttttaaagttttatttaattttatattttttagtgttagttgtgtaaagtttttttggttatggtagtgagcggttgggttgtgtcgttaaatttttcgtattaatttggtttgggatttaattaagtgatttttgatttttggaaagagtttgtttttagagtttatttagaagatggtttaattagatatttttttgagttgttaggttttagacgggtgggagttttgttttgtttaagttagtttaaggacgaggttcgtttggatttagtttggagttacgtgatgggcgtgagtgtgtgagtttttggtaaggcgtagaggttagatggagattttgtattttgttcgagaagtgttttattttttttaatatttggtttttttttgtatataaattaagttgaaaatagtttattatttattattttttatagttatggaattaaataatttagaaattaaaagttttattgtagttgtttttttttttattttttaaatggaatttaaaaagttttggtttgttaaaaggggaagattattttttgaattggaagtttgtagatatattgagtaatagttattttttttgggtttttgtaaatggtatttatttttttaatttatagttttagttgtttaattatttgagatttggggtaattatttgggggaatagtgtttagatggtagtgggagttattattttatagtggtttggggaagagaagagaaagagattagaggagggggtatttgttaaaattatttaacgaatatgttgttaatgtttttttatatttgtatgttattgttatagtttttttaggtgttattgagtttttagaaagtaattatttgtcgaattaagtaaaataaggagaatggtatagtatatgtgtttggagaaggggaaggaagggtggaatatgaaattgagtatagatatttaggttaggaaagaaggaagtggtaaggggttaaatgaagttttattttttcgttatttttttaaataatagttggattaaatatttatttgtttttttttttttttttttttttttttttttagtttatgtttattttttttttttattttttttgtttttttttttttttgtttttttttttttagatatgttggtagttaatatttagtattagttgttatggtgattataaattatttaaatttaaaaatatttatttataatttgagatgaagtttttatttttttagcgaaataatattttaaaagttgttagttgataaaaaaaaaggaatttattttattgtagtaatttaagtaatatattatttttaaaggtttaaattaaaatgttagtttgttaaaaatatgttggtagagttttggatatttttttcgttagatttttataaagaagttgattttgttatttttggtcgttttttaatatatatatataattttgtatgttttttttttttttattaattttttttttttttattaattattttagtttttaaagattttacgtattgggttttaaaagaaaagaatttttttttggattagaaaatagttttattggttgttgaagtgaaagatgtggggtttagggggaaaggttattaggattataatggcggtggtggtaggaggttattttagaggagttaagaagaaaaaaaaatgtagggagaaggattggaggtggaaagatagagtaatagaaaattgagttgggtggttaggtgttgcggtgaagtttagtttcgaaatgataggtatatatttttttatttttgttttttttttttttgagagaaaatttttttagttagagattttggggggtaggaggcgggtaaacgtcgttgtagttgggttttttgttttttattttgggtttgttgttttttgtttattttggattatagggtattcgtttagatgaagagttattaattatttatttagttaatattaggaagacgataaagttttttatataggattaagaagatattagattgttttattagtatatttttgtttacgaataagttttcgttatatatttttttttttttcgagtcgttttaataattgttgtatatattagtagcgggcggtgaggaataatagtcgaattagttttaagaaattttgtgtatcgagttagtagcgaggaacgcgatttgtgaagattatttttgcgggtagggattcgtagggattgattattttcggataattggtataattttttttgggggtgaaaaattataacgcggcggggtattttttaagtgagttgtagatttgattggcgcggggggtgggggaggggaggggagaatgggatggcggaggtcgggcggaggaaagaaaatggaaaattttttttatttttatttcgttgttttttttttaagttttatgtttttttcggtaagtatttgtttttttcgcgttagttatagttagagttttttatttttttttatatatttttttttttttgataaggtttaggattttggttattattttacgtattattattttgcgttttgttagagacggtttgggttgatttcgttggtgtttatgttaggattaaaatttttttatgacggcgaggaaaattgtattatttgtttttagggggtatattaggagtttacgtagtatatgtttcgtaaatattcgttgattgaatgagaggcgcgggggcggggcggcggagaggggtttgcggtcgttaaggtcgttagggttaatttaggtttttcgaagaaggttgggatcgagttgttgtcgcgtgtgaaggtgtgtgtcgcggttgggggtgttataacgggttatggagtttattttttagagggaggaagtttgtgtatattagcgatttgggtcgaatatttttagtttatttattgggttaaagttatttaataattaatgcgtttttgggggaggtcgggggaagtattcgttttttgtcgggacgtaaagttaggcgttaggtttaaaggggttgtagtgtagttcgattttagtacggaatttagagtcgtcgttttgaaattttttaagttagtgatagaggagggttagttcgttttttttttgagggtgaagattattttatgagttttttttaggatttttaaagtaagaaaagttaaagaaaggtttttttgttttagggggtcgtttttagttggtttttatattattttttgttagttgcgtttatttttttttaaatttttggtttttaggggtttttagtcgttttcgtgttattttcgtttcggggttttatttaggttgggtattcgtttaatggatattaaggagaatgggatttattagggaaggaaggtagagtttggattgtttagaggtggattttgtttatatagaacgtttagtttttaacgaggatatggtatttttgggcggcgttgggggtagaggcggagagggtagcgtaatagattattacggttttttgaagaagttatatgttattgtgaattttttttttttttaaaagtaaagaaaaattttaaaaaaatataagaaataaatttttttgttttataagtaggttgtggttaggattttggatattttataagttaatttaaaattagggaaggataggtgttttattttttagtagtgttatagttttgtttattcgtgtgatttttttttgtcgtttattagttttttaaaagttaattaaattaagatttttagtatttttttttattatatgtttttttttaattaatggtattaaacgtgtttaggtagtaattttttttttcggttaaaaagtagaaaaagatatattgagtgtaggggaagagttttttacgtgtattaaaataatgcgggtttgaaagtaatggttaagaaagtaattatttattatttttagttttttatgtgttagttattaaaagcgaacgattaggggcgtttgcgcggtttgtgattggcgtaagtagaatttttttgtttttagtcgttttttgtttatttacgaggattttattttatcgtaggtttttttatttgtttttagaatgtattttttatgtttaggaaatttggggtagggattgggggaaggagatattttgcgtttttttggtttttagtataataagaaatgttagtttcggtttggcgattgcgagttcgtttcgcgcgaagcgagattggggagtttttttagtttggtcggagttagggttgagttcgcgtaaagtattttttttagaagttatcgttgtttttgatttttaattatattttaaatatattacggtttaataatttatttttattatcgattattaaatagaagaagaatttaatataatttaaatgatagaaattacgcgacgttatttttgtattgtttttatttaattttatggggttaatttcggataagtgagcgtttaattggtttagtagggcgattggcggtgtagtgtagtgttcgggcgtgaagtattggatcgttttagacgttttattttaataaatgattatttttttttagatttacggggaaattttaatgtaagatttttgttttttttttagtaatacggtttgtttttttgatcggggttttaaatcgtttttttttattttatattatatttgtatttttatattttaattcggaaagagggggttaggggtcgagggttgtgggggggggggggttttatttgtttatattattaaaggttaatagttttttaaggttaggtatttatttattacggagttaggaaaatagaggaatagtaaatttgaggggtttttttttatgtatttgaaaagaaaggtatttttttttttttattttttatattttttttttcgttttatagaataagttttaatttaggaaaggtttgtggcgtaggttggagattttttaattttttatataagtttgtagattttttttggtaatgtttttcgatttttttagagtgaaattagttaattaagtaacgatatcgttaaaatttaaggtttggtaattagtattttaggtaggttcgcgtcgataggggtaaatttttattttattttgggttgttaagtatagtggttgttttttagttttttagggatgttgtcggtttttcgttttttttttaattagttaaagtaaattttcgttaatttaagttttttttgtttgtttttcgcgatgaatcgcgtatttataagtttgggtggggcgtggttgagagtttgagtgattgagtgggttttggtggtgttgcgcgtagcgggatataacgagcgatagaggtcgttgttggattatttttttacgttagtttagacgtcgaggtttgttggagcgtgcgtaggggattagattatagggagcgagcgagagggagagagaggtgttgggttttaggagtgtagtataatttggggaaaggaattaacgtttttgggacggttgtttttcgttttatttagaggcggagtgtttaagtttaagtagtaggcgcgttaggtttggcggtttcgtttttttgcgtttcgttcgaggtttagagtttcggaggcgggtgtttagcgcgcggtttgcgtttttttttcggttttattattggcgttaggatgttgtcgcgggaagaatttgttgttggttgttttttttcggtttttaggagagttcgtgaattcgatttttttgatttcggagtttttggagaagagatatttaacggtcgtcggttgtacgtttgggttacgcgcgcgttcgttttacgtgcggagagaggcgtttcggatcgcggtcgaaaggagtcggggacgggaggagggggaggggcgaggtaggtcggaggagaaagagggataaagagtaaagatttagttagaggaaagagttgacggtattttcgtttttcggattttttggtaattcggggtaggatggcgtattttttttgcgttttttcggttgtcggcggttttagtcgggaggagtaggttggggggtttcggtatatagcgcgtcgttgttttttagtttatcgtttcgttatagggagaggttattggcgatttggttttgattttttttttgtttaggttggtttttcggggaagcgtttttcgttggggtttcgtcgtagggttagtgtttttttgtcgtttttacgtggcgcggtttttcgttcgatgattcgggtaggagaagggggtttttatttaattgtatatacgtcgatattagtttgcggtagttggtttttatttttcgttatttgtaaaatagaagagaaggaaggttgtaagaagcggcggtcgtcgagtgagtagggtttagatgagattacgttatattagttgttaggcgtttattgtgtgttaggttttaggcgtgttttttcgatttgatagtttttggttgtgtagtagtatttttagtttagtttcgggtttaggatatttatttattaagaggggatttttttttagagttgtcgtaaaagtgtttagaggttagaggattataaagttatagtgtgttggggaggttgtggatttatttttaagaatttcggtgtcggggttaagaatttatttgaacgtaatggtagcgggagtgggtgggtggagaggatttttttttttgggaagttgtatgtaaagattattttttagtgtttgtttattagttggagttcggtaaatatttgtagaatattagcgttaacgtgtttttgttttagatagtagtttttttcggttttttgtaattttgaaacgaacgggtttttggtttagggtgttttaggagcgagttgagttcgggttttttatttattaggagttatttttttatatttagttatatttttttttagagatattaattcggttatttatttatttattataaataattattttaaagtatgatttaagatcgtagaggagagatattgggtggattgagcgagattgaggagagtagggtaaacgtttttggagggtttattgttcgttaaggacggagaaatagttttggtataattgttatttagttttttttttttttttttcgggcgagttaaattttttttacgtttttaattataacgtagcgagttaagtatttaacgcgtttttttttttttgttataggtaagtcgggagaggtgggtttcgaggggttttatcgggtgggtagaagagtcgcggttgttttaaagataagaaaagaaggtttagggttttttaggttttttcgattttagcgtttgtttttttttacgttaattagggtacgtcgacgatcggagggtttatttcgcgcgggtgcggggatcggggtgggagtaagcgttgtcgggttggcggaggtatagaggcggggtagggagttgcgggtttgtttttggtttgagtatcgtttttttgcgtttcggttttttttgaagggagttgggttttggggagtttttggttaaggtcgttgtttataggaggggttgttcggcgttgtggcgtggggatttagggtggggacggttaggcggtttttttattcgttagcgagaacgcgggcggggattttgtcgattcgatttttgtgggttcgtgggtttagaagtagtagtttggcggttttagatttagtgattttgtagtaaaattataggattagtttttgattgagatgtttgttcgtgagatattataaaatttattattatagttttttattaattcgatatgaagtaatatagatgggattttattagtttagattttaaatgtttatttatgataatttcggaggaaatttgtatgttattattatttcgataattttttttttttatatgtttgaattggttgtattattagttggtagtcggagtattgtagatggtaattgtaaatagtttttatttatttattttttttaaagaatgaaatatataaaagaaaaagattgcgttgtttggtgtaaagttagttaattattatatatttttttttttattttttcgtgttttagtgttgaagattaaataaagtaatataaaataaatttttaagaatttatagagttttattttaaggattgaaaagaaggttaaggcgtgttttttagtttatttttatatgtttttgtgatttggagatttattttgtagttaaaatgagttttgagatttgtatttttatgttttatttaatgattaggtttattagaagaattgagtttaaataattggggaagataattttttaaaaagagatttttaattttcgtttgttgatttttaaatttgttttattaagataagttttttgtgagaaatttggttgttagatttcggaattggttttaatggttaattttataaattgagatgggagattttttttgatgggaggtagtttttatttttaaagtttatgttttagttggaatgtatatgttaaggatttttgttttggttaatttgggttttatattgtgagtatataaaaagtattatacggttaacggaggacgaggaattatggtaaagtaggtaggtaagttttaagaaataaaataatttgttaaaaaataatttttgatgattatcgtaagattgaaagtgtaggaaaaatatagttcgaataattttagatttttttatattttttttttttttatatattttgttattttataataaaatttttaatggaaagtttaaaaataaatagtataggaatatgtgttttaaatgaattaaattgtgaaattagttagtaaattaatttgtagtaagtaattatttaaggaaattaaaatattgtttagtttagttttgtattttattatgtgtatgcgttttttataattaattaatataagtgttttaggaatatttgaagataaatacgtttaatttaaggaataaagtatttaaataatttaagtgtaattttgttgagttaaagtaaaatattttataaatgaagtggttatttaattttttagggaaagtttggttattgaaatgttgtatgtttatgttatattaataaaaatttttaatttattttgtttatgtgttttgtttttttgatattattggtatttgaattttagatggatttttgttaaaatgatattttgtgtgataaaagtatttttagttttgattgatagattaaaataaatgtaaggaaatttttttaaattagattaattttttataaaaatattttagaatgtatgaattttgatatttatatttataatggtaaaagtttttttcgtttagtttagtaagataatatttatataaaagagtaaaaaaaaattatattattttatgatagtttgatttttaaattgtttaagaaagtaaagtggttaaattggaaaagaggaatatatttcggaggtttagaatcgaaaattttttttttaatttttagttggaaaataattttttgtatttatttaaagtgtattttttgaagtgttagattggagttgattggtgattaatttaaaggagttataatttaaagaaatggtgagagtttggtatttaggtttggtttttaggtaattcgtttgggtttgagaggttattaattgttagttaagatggaattttttttttttttttttttttttaatggataataatgggaagggggttaattttttagtagttgaaattttgtatttagttttttattttgagaatgttaatttttggttcgaggatttgtttttgtagtgttggtatcgagatttaagggaagatatttcgttttaaatgttagttacggtttggtttttttttcgattttagtattttgtagattgttagtgtttgtggcgggggacgaaaggaatagggttttgtaaggtttgtttgtcgattgcgttattttgggcgaaatttagttttaaaagttataaattatttacggtgaagatttttcgaagtggaataaatttttagattcgtattattttatatttttgcgggatagatggtttttatttatcggttatcgggagagagttgttgttttcgcgttttattgtttttcggggcgatttttagcgagtcgagttttcggttgtacggtaagcgttcgaaagtcgggtttgagaggattgtagggtttttgagggtgttaagtttcgaaggagtttacgggtgtattggggttttcgaaatttagtcgttattggtagtttttttttgtttttttttagttttttcgttcggtttcgtattttttttttttttttttttttttattttttttttttttttttgtttttatttcgtgtggggagtgacgtgacgttagtagagattttattaaattttattgtatagtggcgcgcgggcggtcggtcgagttcggttgcgcggttggcgatttaggagcgagtatagcgttcgggcgagcgtcggggggagcgagtaggggcgacgagaaacgaggtaggggagggaagtagatgttagcgggtcgaagagtcgggagtcggagtcgggagagcgaaaggagaggggatttggcggggtatttaggagttaatcgaggagtaggagtacggatttttattgtggaaaggaggattagaagggaggatgggatggaagagaagaaaaagtaatttgcgttaattcggtagttttaataaattaaagggggagcgttagggtagcggggagatagaaacgtatttttggggagtaaattaggacgggttgggaggaagcgatagggaaagtggtttaagagacggaataaaggataatgtttatggggttgtttgggacgaggcgtgtggagtgtgggtgtgagcgtgcgtgtgtgatttttttttaggtttgtagagttgaggaaagaggttatagtaaagagggattgcggagggaggaaagtgagagatcggtagagggcgggagtggaggtgggcgcggtggggatgggagaggatgagtgaagagaaatttagaagaatggagtgagttagtgggagagggtgggagggttatagtcgggagcgaacgagttaggtttgttagttggggaaggtcgggacgttgggtttagtttagttgggatatcgcgttcgaggttaaggcgggtggattaggtatgttgagagtgtcggcgtataggtgggtacggttacgtattgatttagtgtttacgaagggtttgtattggataaggtttagacgtttatagagtttagaattttttttgttgtatttatatttaataagtttattttgggttacggatattttattttttaaaatgacgaggttaaggtttttggcgaggatggtattaaattgtacgggatagaagtgggggtgggggagagagttttttttaagtttatatttgtttttgtaaagtaaagagtatgtgaaattatagggtatatttttattcgaaaagtgtgttttatttttgaattttgattttttgattttttgatttgagtaaagatgtgtattttggtagtgagtagaatattttggttttgttttgtttttgagtggaaggattataaatataattcgtttggaggattaggtgtgaaggtttttgttaggtatatgggataatgtttttttaattttaagggtattttgttaatgtatgtttttggaaagtgtcggaatatagttattgtttttggattcggatttttttattaatattaatttttgtttgagagtaaaatttaggttcgttattaaaaagatatttttttggtttttaattgagaataaagttttttttaaaagttgtattgttttttttaaattaatatattaatattcgtaattttagaaatatatagtgattcgggagaatgtgtataaaatagatacgtttaaaaaagtttggcgtttaaaattaattttagttattatataggtgttgggttttttttatttttgggggttgtttggaatatgttatgtgtttttttgaattatttcgtgttttgaatttatttgagttagtagtaaaaataggtaaataaatttgtttaatttgttttgagtgttaaatttttttattttgaaatagttaatagtcgatagatggatttattttatggaaagggttagtttttttagttacgaagaaaattgattagagatttatattttaagttatttttaatttttacgtaatattcgtgaaaatttaaattttttttttttatttagtggaaatttaaagtagtgttatttaaggggagagaaatgagggggaaaatgtttacgtgttgtttaattgtattttttttttgattttgagaatttttatttttggtttttgaaatttcgtcgaggtaagaaaattaaatttttttaataagttttataattgaattttagttataggatatcggaaagtgtagttcgagaaagatatttttatttttgtttatcgacgatttttgtagtttttttatttttttgagtaatgggttaataattttttttttttttttttttattttgtagagattaagaggcgttcgtagtagaacggttttgtttttagttggtggcgaggataggtaattttatggaaaagttggaagagaatgagaaaattaaagatagaaagatttagagattcgcggagagatatagggagagggaagggagttgcgttgaaaagacgtaaagatacgcgcgtgtaattttttttttttttaggttttagaggtttgtaaattagggttgagaggaaggggttcgggaagtttacgtttttttcgttttttttttgtttggagtttcgttcgttagaggttggttaattttagtttcggtcgtcgtagatattgcgttgagtttttgggttttcgttttgtttagcgttagtgtagttgaagtgagtagttggtgggaaatgtaaatggtttttggagaaatagaagatatagaatgatttttatttttttttcgagtgtgtggaaggagttggatatacgttttacgtttttaattttttttttatatttttagttatatttttattaaataattaattaatgtttagaattattagggaatatattaggtatgtaatcgtagaagtagggtgttggggggttataaattatcgagttgatttaagacgtggattttaggttttttttttgttaaagtagtaaaggaagagcgggttttggcgattgtatttagatttcgattattttaaattagaagggggtggagggagcgtttaagtaaagtaagtaattttttgttttgtagatgtaaataagattgtagtattaaaggtattagtttttttagggttagatcgtttggattgggagtttggggaaggggagatattaattttacgtatttgtgaattttaaggatgttatatttttatataaataattttagtgcggattttttggaatggggggagtaatatttttattttagaatattaaaatattttttttttaaagcgtatattttttttatttttttaaaattttgaattatgtttaaagataatagttttttagtaaattggagtattggattattttttttatttttttttatcgatattttgatgatttgattttaatgtgtggggggtatagggaattaaatatagtttataaaattaagtttagatgaaatagtgttggttaagtgggtttagataatttttaatgagaattttaattatatttttttttttaatatgttgagataagtgatagaatcgttagaatggtaattaaattggaaagtttagggagaataataatttcgtgattaaattggggtaaaatcgtggataaatgtggggtgattttcgttaattttttgttatttaagagttaggatttgggaaaggtatagtattattttagagttcgttgtgacgggttgtgtgttattatttattttttttattttggattatgattttaattttggtaagtaatttttttagttttttatttgataataagcgagtatgtaaatattaatggttagcgatgtttaattgttttaaatattattgatttgttggttgttttaaattgtttttttagtttaggttttgttttcgaattgtttattttagaggtttgatttatgttttcgatgttataatataataattgtttttttaaaaaaggtatttaagatgaattaattgatttgtatataaattaaaattattatgcgttgtcgatttcggtgttttataattatttcgaaattagtatttaattatttgagttaaaagaatatataaatgtttgtattgatttattaatgaattatttaattaaaacgttcgggtaatgttgggcgttggaaagattgttaaattaagatatattataggagggatatgaagattagaaaggtaatagattaatatttcgtatttaaaacggagttttcggtgatttttagttttaattttggagtaggggttttttttttttgttgttaaaaagattttgtgtttgtttgtgagtgagtgtatttaagtggaaggaacgtttttacggttacggtggtttaggttttttgttcggatcgggattttatagttttaatttaggagcgttaaattttggaagatttcgggttagttttggaggtgcgtggtttcgtaagtcgttaggttaagtttgttttttttgtttgttttttcggtaggttgggcgcgttatggtagtgagtttttcgcgtaaacggagagttggaattaaagttgatatttaatagatatgttaattgagtatttattttcgttttgagaataggaataaaaggtagttttttttaagagaggcggtgtaaaggtacgttataggagtttagaaaaggttggcggcgggaaatttgtagtttgggggttagttaatatttttttttattttaagtatttattgatttgttgttgttatttttggcgacgtagaaggatatttgaaagaatttttgatggggttttgatttgagaaaggaggtgatttgtttaggtttttattaaatttttaattattatattaattgtttttttttattttttattcgatttttttttttttgtttatttttaattttttaattatttagaaatttttttattttttagtggttttttttttgtagtagttttttattcgaatttttttttcgttttttcgtggtagggtttgtatattgatttttttgatttttggtatatttgggttttttgaaattttttaatttttttagatttgaggatggtaggttttattttttttattgtgtgtatatatttagagatatgaaaatttatatagattgtttttaaatttagggtatttaatagatgttttttttttagttcgttttttgatttgaaatgtttgtttgattttaatttggatattatttttttttgtttttttttttttaaagtagtttggatatgtgtgtaagtgagtttagaatagttttatttatattttttattaaattgtaaataaaagaagaattaatgaagtagattggtatatagattgtattaagagttcgaatttttagtttttggattttttatttaattttggttgttatttatattgatagagttattttaagtagaggtttagagaaatttgtattgtgggataataggtaaagttatagtaaaaagtggaataattttaaagttattttattagaatgtaaattgtatttttgggttttgttcgtaattatttagttttaatatatatagagttagataggaaaaaataggttaatatagttattggtattagagaagataaattttatgggttttttagtgaaaagaagatttttaaagtttataatttttgattatttaattttatttataattgtgggaatgaataagatattaattgttttatgtattttatttatattaattaatttgtgtttttattaaaagtagttatatagaattttttttaatttttggtagtaagtttagaaaatgaagtttatagttattttgaattggatatattttttgagttgattatttttgtaagtgtaggaatataatattgtttttttatggtttttttgtatttttttagggtttgtaagtttttattaggtttgatattattgtttgggtttatatttattataagtaaatttgattattatgttgattttaaaatagtttatttggttagtataattttagtttttaaattataaaaattttttaatatacgaagtttttagtttttattttttttagttttttgtttatttaaaatttttattttaattggtgtaagtaataataatttgtattattatttgtattttttttatttttttggagattgggttggattttagagagaatattagtattattattattataaataataaaatttaaaagtaaagtttttatttgtatgataattggtatttggaatgtttttgatttatttaatgttattttataaaggtattttgtaaatttttttggaatttttagtaagagtttgtagtaattggaataattttttgggaagatattttttttgatgggtttttagtttttggaggaatagattgagagtaattagggagggaggggatattggaaattggtagttacgttagttgaaataagtttgggtttagtaaggtgattgatgttgtggttgattttttatttcgagtttttttttaattggggtattgattttttttattttgggattttaaggtattcggtgtgtatgtagattttttttttgtggtttttattatgtggtttcgtagtaggtttttggtttaatgatattttatagttatagtttttatatttattattatgattttaatgtttaggtttttagtgtatttatattaaatttgttttattagtaagttggagtatataggagagatgggggtaagtaaggatttagtagagtttaaatttagatatgtttaaatggttttgattgtgtaaagtgtggtaatgttttttgttgttttagttttttattttaagttttatatgttttttggttaatgaagtgtgatataggttatatgttaggaataatagtatttgttgagaataaagtgaatttaggaaatttggtatatataaaatgtatt

SEQ ID NO: 1133 - DNA, 28536 bp, Artificial Sequence
  chemically treated genomic DNA (Homo sapiens)
gatgtattttgtgtatattaggttttttgagtttattttgtttttaataaatattattatttttagtatgtggtttatattatattttattagttagaggatatgtgaagtttagagtggaaagttagggtagtaggaagtattgttatattttatatagttaaagttatttaaatatgtttgaatttgagttttgttgagtttttatttgtttttattttttttgtgtgttttagtttattaataaagtaggtttaatataaatatattaaaagtttaaatattgagattatgataatgaatatgagggttatgattataaaatattattgaattagagatttgttacgaaattatatggtgaagattataagggaggaatttgtatatatatcgagtgttttgggattttaaagtgggaagagttagtgttttaattaaagagaaattcggggtagggaattaattataatattagttattttattgaatttaggtttgttttagttgacgtagttgttaatttttaatgttttttttttttttaattgtttttaatttatttttttagaaattgaaagtttattaaagaggatatttttttagagagttgttttagttattataagtttttgttagaaattttaagaaagtttataaggtatttttataaggtggtattgagtaagttagaagtattttaagtattaattattatgtaaataagggttttatttttagattttgttgtttgtggtggtggtgatgttggtgttttttttggaatttagtttaatttttaaaaaagtaaaaggagtataaatagtaatataaattattattatttatattaattaaaatagaagttttgaatgagtaaggagttagaggaggtaaaaattgggaatttcgtatattaaaaggtttttataatttgaaaattaagattatgttggttaaataggttgttttaaaattagtatagtaattaaatttgtttgtaatgaatgtagatttaaatagtgatgttagatttgataaggatttgtaaattttaaaagagtgtaaaaagattatagaagaataatattatatttttgtatttatagaaatggttagtttaagagatgtatttagtttagggtggttgtaagttttattttttgaatttgttattagaagttaaaagaaattttgtataattgtttttgatggaaatataaattggttgatgtaaatgaaatatataaagtagttggtgttttatttatttttataattataaatgaaattaaatgattaaaaattatagattttggggattttttttttattgaggagtttatggaatttgttttttttagtattaataattgtgttgatttatttttttttgtttaattttgtatatattaaaattaggtggttacgaataaaatttagaaatataatttatattttaataaaatgattttaaaattattttattttttattgtggttttatttgttgttttataatgtaggtttttttgggtttttgtttagaatgattttgttaatgtagatgatagttagagttgaatggggaatttagaaattggggattcgggtttttgatgtaatttatatgttaatttattttattagttttttttttatttatagtttggtaaagaatatgggtggagttgttttgggtttatttgtatatatgtttaaattgttttgaaaaaggaagggtaagaaagagtggtatttaagttggaattaggtaggtattttagattaagagacgaattggaaagggaatatttgttagatattttgggtttgaaggtagtttgtgtaagtttttatatttttgagtgtgtgtatatagtggagagggtggagtttgttatttttaaatttgaaaagattgagagattttagagggtttagatgtgttaaaggttagagggattaatatataggttttattacggaaaggcggggaaaaggttcgaatagaaaattgttgtagaagggaagttattgagaggtaagggagtttttgaataattaaaaagttaagaataagtaaaaggaaggaggtcgggtgggggataaaaaaaagtagttgatgtggtaattaagaatttggtgggagtttgggtaggttatttttttttttagattagagttttattagaaatttttttaagtgtttttttgcgtcgttaaagatgataatagtaaattaataagtgtttgaaatgaaaggggatgttgattagtttttaggttatagatttttcgtcgttagttttttttgaatttttatagcgtgtttttgtatcgttttttttaagaagagttattttttatttttatttttaggacgaaggtaagtgtttagttagtatatttattaaatgttagttttggttttagtttttcgtttgcgcggaaagtttattgttatagcgcgtttagtttgtcggaggggtagatagaaaaagtaagtttggtttggcgatttgcggggttacgtatttttagggttggttcggagttttttagagtttaacgtttttgggttagaattgtaaggtttcggttcgagtaaagggtttgagttatcgtagtcgtgggagcgttttttttatttgaatgtatttatttataaataagtataaaatttttttaatagtagaggagaaagatttttgttttaaaattaaagttgggaattatcggaaatttcgttttgagtgcgagatattggtttgttatttttttaatttttatattttttttgtaatatgttttgatttaataatttttttagcgtttagtattgttcggacgttttaattgggtaatttattagtgagttaatataggtatttatatatttttttagtttaagtggttaagtattaatttcgaaatgattataaaatatcggaatcggtaacgtatagtaattttaatttatatgtaaattaattggtttattttaaatgttttttttaaaaaaataattattgtattgtagtatcggaggtatggattaaatttttagaatagataattcggaaataagatttggattaggaagataatttagaatagttaataaattaataatgtttgaggtagttaaatatcgttagttattggtatttatatattcgtttgttgttagataaggagttggggaaattgtttgttagggttgagattataatttagagtgaagaaagtaaatggtagtatatagttcgttatagcgggttttgaaataatattgtattttttttaaattttgatttttgggtgatagggagttggcggaggttattttatatttgtttacggttttgttttaatttgattacgaaattgttgttttttttgagttttttaatttgattattattttaacggttttgttatttgttttaatatattggggggaggagtgtaattgagatttttattaaaaattatttgaatttatttagttagtattgttttatttaagtttagttttatgggttgtatttaattttttgtgttttttatatattaaaattagattattaaaatgtcggtaggaaagggtgaaggaaatggtttaatgttttagtttattggaagattattatttttagatatagtttaaaattttgaggaaataaaaaggatatacgttttggggggaaaatgttttaatattttagaatgggggtattattttttttattttagagaattcgtattggagttgtttatgtaaaaatgtaatatttttgaaatttatagatacgtaaggttagtgtttttttttttttaggtttttagtttaggcgatttagttttaaaggagttagtatttttgatgttataattttgtttatatttgtagggtagagaattgtttgttttgtttggacgttttttttatttttttttaatttgaagtaatcggaatttaaatatagtcgttaaggttcgttttttttttattgttttgataagggaaaaatttgaaatttacgttttaaattagttcggtggtttgtagttttttagtattttgtttttacgattgtatgtttaatgtattttttggtgattttgggtattaattagttgtttaataggagtatgattaaaaatgtaaaagaaggattaggagcgtgaaacgtatgtttagttttttttatatattcgaggagggaatgagaattattttgtattttttatttttttaggagttatttgtattttttattagttgtttattttagttgtattggcgttgggtaaggcgaggatttaaaagtttagcgtagtgtttgcggcggtcgggattggggttaattagtttttggcgggcgagattttagatagaaggggggcgagaggaacgtgagtttttcgagttttttttttttagttttggtttgtaaatttttgaaatttgaaaggggagggagttgtacgcgcgtatttttgcgtttttttagcgtaatttttttttttttttttgtgttttttcgcggatttttgaatttttttgtttttggtttttttatttttttttaatttttttatgagattgtttattttcgttattagttgaaggtaaggtcgttttgttacgagcgttttttaatttttataaaatgaaaagaaaaaaagggaggattattagtttattatttagaggaatggggaggttgtaaaaatcgtcgatgggtagaggtgaagatgtttttttcggattgtatttttcggtgttttgtaattagagtttagttgtgggatttgttgaagaaatttgatttttttgtttcggcgagattttaaaaattagaaatagaaatttttagagttagagaggaaatataattaaatagtacgtgggtatttttttttttatttttttttttttaaataatattgttttgagtttttattgggtaaagagagaaagtttgagtttttacggatgttacgtggaggttagaaatggtttaaaatgtagatttttaattagtttttttcgtggttgaagaggttaattttttttataaaatgagtttatttgtcgattgttagttattttaaagtgaagggatttagtatttaaaataaattgagtaagtttgtttgtttgtttttattgttaatttaaatgaatttaaaatacggagtaatttaagaaaatatataatatgttttagatagtttttaaaagtagggaaagtttagtatttatatagtgattagggttagttttaagcgttaagtttttttaaacgtatttattttatgtatattttttcgagttattatatatttttaaaattgcgagtattggtatattgatttaggaagagtaatataatttttagagggaattttatttttaattagggattaaagagatgtttttttaatagcgggtttgagttttgtttttaagtaggaattaatattggtgggaaaattcgaatttaggagtaatggttgtgtttcggtattttttaaaaatatatattaataggatgtttttgagattgaaaaaatattgttttatatgtttggtagaagtttttatatttggttttttaggcgaattatatttatagtttttttatttagaggtaggatagagttaaaatattttgtttattattaaaatatatatttttgtttaagttaagaaattagaaaattagggtttagaagtaaggtatatttttcgagtgagaatatgttttgtaattttatatattttttgttttgtaggagtaaatgtggatttgagggaaatttttttttttatttttatttttatttcgtgtaatttaatattattttcgttaggaattttaatttcgttattttaaaaaatgagatattcgtgatttagggtgaatttgttgaatgtaggtatagtagaggaaattttagattttatgagcgtttgagttttgtttagtgtaaatttttcgtgaatattgggttagtgcgtggtcgtgtttatttgtgcgtcgatatttttagtatgtttggtttattcgttttgatttcgggcgcggtgttttagttaagttgggtttagcgtttcggttttttttagttgataagtttagttcgttcgttttcggttgtggtttttttatttttttttattagtttattttatttttttagatttttttttatttatttttttttatttttatcgcgtttatttttattttcgttttttatcggttttttattttttttttttcgtagtttttttttgttgtgatttttttttttaattttgtaggtttgaaagaaggttatatacgtacgtttatatttatattttatacgtttcgttttaaataattttatgaatattgttttttgtttcgttttttgggttattttttttgtcgtttttttttagttcgttttgatttgttttttaaaagtacgtttttgttttttcgttgttttggcgttttttttttgatttattagggttgtcgggttggcgtagattgttttttttttttttttattttatttttttttttggtttttttttttatagtgggagttcgtgtttttgtttttcggttggtttttaagtgtttcgttaggtttttttttttttcgttttttcggtttcggttttcgatttttcggttcgttggtatttgttttttttttttgtttcgtttttcgtcgtttttgttcgtttttttcggcgttcgttcgggcgttgtgttcgtttttggatcgttagtcgcgtagtcgggttcggtcggtcgttcgcgcgttattgtgtagtggagtttggtggaatttttgttgacgttacgttattttttatacggagtaggagtagagggaagagagagggatgagagggagggagaggagagagagtgcgagatcgagcgagaaagttggagaggagtagaaagaaattgttagtggcggttagatttcggaggttttagtgtattcgtggattttttcggaatttggtatttttaggagttttgtagtttttttaggttcggttttcgggcgtttgtcgtgtagtcggaggttcggttcgttggaaatcgtttcgggaagtagtgggacgcggagatagtagttttttttcggtagtcggtaagtggaggttatttatttcgtagggatgtgagataatgcgagtttggaaatttgttttatttcggagaatttttatcgtaggtgatttgtggtttttggggttaagtttcgtttaaggtaacgtagtcggtaaatagattttgtaaagttttgtttttttcgtttttcgttatagatattaataatttatagggtgttgaagtcgagagggaagttagatcgtggttggtatttaaaacgaggtatttttttttaaatttcggtgttaatattgtaggaataaattttcgggttaaggattagtatttttaagataaagggttgggtataaagttttagttattggaagattagttttttttttattgttatttattgggaaaaaaaagaaaagaaaaagattttattttaattggtagttagtgattttttaggtttaagcgaattatttgggagttaggtttggatgttaagtttttattatttttttggattgtaatttttttaaattgattattagttaattttaatttggtattttaggagatatattttaaatggatgtagagaattattttttagttggagattaagaaaaaaattttcgattttaaattttcgaaatatgttttttttttttagtttaattattttatttttttaagtaatttagaaattaaattattataaggtggtgtgatttttttttatttttttgtgtgagtattgttttattaaattaaacggaaaaaatttttattattataaatgtaaatattagaatttatatattttaaaatatttttatgaaaaattaatttgatttaaagaaatttttttgtatttgttttagtttattaattaaaattaaagatgtttttattatataaaatattattttggtagaaatttatttaaaatttaaatattaataatattaagaaaataaagtatataagtaaaataaattgaagatttttgttgatgtaatatgagtatataatattttaataattaaattttttttaaaaaattaaatagttattttatttgtggaatgttttattttaatttagtaaaattatatttaaattatttaggtgttttgttttttaagttaagcgtgtttgtttttaaatgtttttaaagtatttatattaattggttgtaaagaacgtatatatatggtaaaatatagaattgaattgagtagtattttaatttttttaaataattatttattataaattaatttattggttaattttataatttagtttatttaaaatatatgtttttgtgttgtttatttttaaattttttattaaagattttgttatggggtaataaagtgtatgaaaaggggggaaatgtgaaaggatttgggattattcgaattgtattttttttgtatttttagttttgcggtagttattagaaattattttttagtaaattgttttattttttagggtttgtttgtttgttttgttatggtttttcgtttttcgttagtcgtgtagtgttttttgtgtgtttataatataaaatttaagttggttaaaataagagtttttggtatatatattttaattagaatatgaattttgggggtgagaattattttttattaggaaaagttttttattttaatttgtgagattagttattgaagttagtttcgaagtttggtagttaaattttttatagaagatttgttttgatagggtaagtttaaggattagtaggcgggaattggaggtttttttttaaaaaattattttttttagttatttagatttagtttttttagtaggtttggttattaaatgaagtataaaaatgtaagttttaaggtttattttgattgtaaaataaatttttaagttataaggatatgtaggagtgagttaaggaatacgttttgattttttttttagtttttagagtggagttttatgagtttttgaagatttgttttgtattgttttgtttggtttttagtattgaagtacggggaagtggggggaagaatgtgtaataattgattgattttatattaagtaacgtaattttttttttttgtatattttattttttaaaaaaaataaataaataaaaattatttgtagttattatttgtagtgtttcggttattagttaataatgtagttagtttagatatataaaaaaaaaagattatcgaaatgatgatgatatgtaaatttttttcgaaattattataagtaaatatttgaagtttggattaataaaattttatttgtgttattttatatcgagttagtagaaagttgtgataatgaattttgtaatattttacgaatagatattttaattagggattaattttgtgattttattgtagaattattaaatttggagtcgttaaattgttatttttgggtttacgggtttataaggatcgaatcggtagagttttcgttcgcgttttcgttagcgggtgggggaatcgtttggtcgtttttattttggatttttacgttatagcgtcgggtagttttttttgtaggtagcgattttggttagaggttttttagggtttagttttttttaggagaggtcgagacgtagggaaacggtatttaggttagaggtaggttcgtagttttttgtttcgtttttgtgttttcgttaattcgataacgtttgtttttatttcgattttcgtattcgcgcgaagtgggtttttcggtcgtcggcgtattttggttagcgtggagagaggtaggcgttgagatcgaaggggtttagggagttttggattttttttttttgtttttaaagtaatcgcggtttttttatttattcggtggagtttttcgagatttatttttttcggtttgtttgtggtagagaagggggagcgcgttaaatgtttggttcgttgcgttgtggttgaaaacgtgaaaaagatttggttcgttcgggagagaaagggggagaattgggtagtagttatattagagttattttttcgtttttggcgggtagtaaattttttaagaacgtttgttttgttttttttagtttcgtttagtttatttagtgttttttttttgcgattttaaattatattttagggtaattatttgtagtaagtaaataaatggtcgggttagtatttttaggagaaagtgtggttaaatatggaaaagtggtttttgatggatgagaggttcgaatttagttcgtttttgaaatattttaggttaagagttcgttcgttttagaattatagaaaatcgagggaaattgttgtttaggataggggtacgttggcgttgatgttttataaatgtttatcgagttttaattaatggataagtattgaagggtggtttttgtatatagttttttaaagagaaaagttttttttatttatttattttcgttgttattgcgtttagatgagtttttaatttcggtatcgagatttttgaaagtaggtttatagtttttttagtatattgtggttttatagttttttaatttttgggtatttttgcggtaattttggagggagatttttttttgataaataaatgttttgggttcgaggttaggttggagatgttgttgtatagttagaggttgttaggtcggaaaaatacgtttgaagtttagtatatagtaggcgtttaatagttagtgtaacgtagttttatttgagttttgtttattcgacggtcgtcgttttttatagtttttttttttttttgttttgtagataacggggaatggagattaattgtcgtaaattggtgtcggcgtgtgtgtaattaggtaagaattttttttttttgttcgggttatcggacgggaggtcgcgttacgtgagggcggtaagagggtattggttttgcggcgaggttttagcgaggggcgttttttcgaggggttagtttgggtaggaaggaaattagaattaaatcgttagtggtttttttttgtggcggggcggtggattaggaagtagcggcgcgttgtgtatcgaagttttttagtttatttttttcggttggaatcgtcggtaatcggggaggcgtagaaagagtacgttattttgtttcgggttgttagagggttcgggggacggggatgtcgttagtttttttttttaattgggtttttgttttttgtttttttttttttttcggtttgtttcgttttttttttttttttcgttttcggtttttttcggtcgcggttcgggacgttttttttcgtacgtggggcgggcgcgcgcgtggtttaggcgtgtagtcggcggtcgttgaatgttttttttttaaagatttcgaaattaaaaaggtcgagtttacggatttttttgagagtcgaaaagaggtagttagtagtaagtttttttcgcggtagtattttggcgttaatggtaaggtcgggagggaagcgtaggtcgcgcgttgggtattcgttttcgggattttgggtttcgggcgaagcgtaagaaggcgaggtcgttagatttgacgcgtttgttgtttgaatttagatatttcgtttttgggtgggacgggaagtagtcgttttagggacgttaatttttttttttaaattatattgtatttttgagatttaatatttttttttttttttcgttcgttttttgtggtttgattttttgcgtacgttttagtaaatttcggcgtttaggttggcgtggaaaagtggtttaatagcgatttttgtcgttcgttatatttcgttgcgcgtagtattattagggtttatttagttatttaggtttttagttacgttttatttagatttgtgggtgcgcggtttatcgcgggaggtaagtaagggaaatttgagttggcgaaggtttgttttggttggttgggggaggggcggggggtcgataatatttttgaagagttggagggtagttattgtgtttagtagtttagggtagaatggaggtttgtttttgtcgacgcgaatttgtttgaagtattggttgttaggttttgggttttggcgatgtcgttgtttgattggttggttttattttggaggaatcgagggatattgttagaggaggtttataggtttatgtaaaaagttaaaaagtttttaatttacgttataggttttttttgaattgaaatttgttttatggggcggaggggggggtgtaagggatggaggagggaagatgtttttttttttaaatatatggaaaaaaattttttaaatttattgtttttttatttttttggtttcgtagtaaataagtgtttagttttaggaggttattgatttttgataatgtgagtagataaagtttttttttttttatagttttcggtttttaatttttttttttcggattaaagtgtaagaatataaatgtaatatgggatggaggggggcgatttgggatttcggttaaaaaaataaatcgtattattaagaagaaaataaaggttttgtattggagttttttcgtgaatttgagagaaaatgattatttgttgaaatgaagcgtttaaagcgatttagtgttttacgttcggatattgtattatatcgttagtcgttttgttgggttagttaaacgtttatttgttcgggattaattttatggggttaaatgggggtaatgtagagataacgtcgcgtgatttttgttatttagattgtgttaaattttttttttgtttgataatcggtagtaaaaataaattattagatcgtagtatgtttgggatatggttaaaaattaagagtagcgatgatttttggggagaatgttttgcgcgggtttagttttggtttcggttagattagaggagttttttaatttcgtttcgcgcggggcgggttcgtagtcgttaagtcgaggttgatattttttattgtgttgggagttagagagacgtaaaatgttttttttttttagtttttattttaggttttttagatatggggaatgtattttgaggataggtggagaagtttacggtaggatggggttttcgtaggtgagtaggaaacggttaagagtagaggagttttgtttgcgttagttataagtcgcgtaggcgtttttggtcgttcgtttttgataattagtatataaagaattagaaataatgaatgattgtttttttaattattatttttaggttcgtattgttttagtgtacgtgaaaggttttttttttatatttaatatgtttttttttattttttgatcgaaaagaaaaattgttgtttaaatacgtttaatgttattaattaagaaaaggtatgtaatgggaagaaatgttgaaaattttgatttaattggtttttaaggaattagtagacgataaaaaaaaattatacgagtgggtaaagttatagtattgttgaaggatagagtatttatttttttttgattttaagttaatttatggaatatttaaagttttggttatagtttgtttgtaaaataaaaggatttattttttgtgtttttttaaagtttttttttgtttttaaagagaaaaaaagtttataatgatatatgatttttttaaaaggtcgtgatagtttattacgttatttttttcgtttttgtttttaacgtcgtttaaaaatattatgttttcgttaaagattaaacgttttgtataggtagagtttatttttaagtagtttaggttttgttttttttttttagtgagttttattttttttggtatttattgggcggatgtttagtttggatagaatttcgaaacgggggtagtacgagagcgattggagatttttaaaagttagaggtttgagagagggtggacgtagttagtagaagatggtgtagaagttagttgagaacgattttttagagtaaagagatttttttttggttttttttgttttgggggttttgaaaggaatttataaaatggtttttatttttaggaggaggacggattgatttttttttgttattggtttaaaaagttttagggcggcggttttgggtttcgtgttgaaatcggattgtattgtagtttttttggatttgacgtttggttttgcgtttcgataaggggcgggtatttttttcggttttttttaggaacgtattaattgttaaatagttttggtttagtggatgggttgaaagtgttcgatttaagtcgttggtgtgtatagattttttttttttgggaggtgggttttatggttcgttgtggtatttttagtcgcgatatatatttttatacgcggtagtagttcggttttaatttttttcgaaggatttgggttaattttggcggttttggcggtcgtagattttttttcgtcgtttcgttttcgcgttttttatttaattagcgaatgtttgcggagtatatattacgtggatttttaatgtattttttgaaagtaaataatatagtttttttcgtcgttatgaagggattttaattttaatatggatattagcgagattagtttagatcgtttttagtaaaacgtaaaatggtggtgcgtggggtggtgattaaggttttgagttttgttagaaagaaggggatgtgtagagaaaggtggagaattttagttgtggttagcgcggaagggataggtgtttgtcgaagggggtatgaggtttgaggaaaaagtaacgaaataggggtaaggagagttttttattttttttttttcgttcgattttcgttattttatttttttttttttttttttatttttcgcgttaattaaatttgtagtttatttgaaaggtgtttcgtcgcgttgtggttttttatttttaggggaaattgtattagttgttcgaaagtagttagtttttgcggatttttgttcgtaaaagtggtttttataggtcgcgtttttcgttgttgattcggtatataaagttttttaaggttggttcggttgttattttttatcgttcgttgttaatatatgtagtagttgttagagcggttcgggggaaaaggaaatgtataacgaaagtttattcgtgagtaggaatatattaatggaataatttgatgtttttttaattttatgtaaaaagttttgtcgtttttttaatattgattgaatgggtaattaatggttttttatttaggcgaatattttgtaatttaagataggtaaaagataataagtttaaggtagaagataaaaggtttaattgtagcggcgtttgttcgttttttattttttagggtttttgattaggaaagtttttttttagaggagaaaaaggtaggagtgggagaatatatatttattatttcggggttagattttatcgtagtatttgattatttagtttagttttttgttattttgtttttttatttttagtttttttttttgtatttttttttttttttaatttttttaggatgattttttattattatcgttattatggttttaataatttttttttttaaattttatattttttattttagtaattaatgaggttgttttttgatttaggaggagattttttttttttagaatttaatgcgtagagtttttgagaattaaagtagttggtaggggaggaagaaattaatagaaagggagagagtatatagaattgtgtgtgtatgttaaagagcgattaggaatgatagagttaatttttttgtgaggatttgacgggaagagtgtttaagattttattagtatgtttttaataggttgatattttaatttaaatttttagaagtaatatattatttgggttattataatgaggtgggtttttttttttttgttagttgatagtttttaaaatattatttcgttagggaaataaaagttttattttagattataggtgggtatttttggatttaggtgatttatggttattatgataattaatgttgaatgttagttattagtatgtttgggagagagaaaatagaaagaagggagagtaaaagaaatagaaaagggagatggatataagttggagagggaagaaaagagaaaaagaggaagatagatgagtgtttaatttaattgttgtttaaaaaagtggcgggggggtgggattttatttagttttttgttattttttttttttttgatttggatatttatgtttaattttatattttatttttttttttttttttttaaatatatgtgttatattattttttttattttatttagttcggtaagtagttgttttttggagatttagtgatatttaggaaaattgtggtagtaatatgtaaatgtgaggaagtattaatagtatgttcgttgagtgattttagtaaatgtttttttttttaatttttttttttttttttttttaggttattgtgaggtggtaatttttattgttatttgaatattgtttttttaggtagttattttaaattttaaatggttgagtagttagagttgtgggttggaaaaatgggtattatttgtagggatttagagagggtggttgttgtttaatatatttatagatttttaatttagaaaataattttttttttttgataagttagagttttttaaattttatttaggaaatggggaaaaggatagttatagtgaagtttttaatttttgggttatttggttttatagttatgaggggtggtgggtagtggattgtttttagtttggtttgtatgtagagaaaagttagatattggagggggtggggtatttttcgggtaggatgtaaggtttttatttgatttttgcgttttattaggagtttatatatttacgtttattacgtggttttaagttgagtttaggcgggtttcgtttttgagttagtttgggtagggtaggatttttattcgtttaaggtttaatagtttagggagatgtttaattaagttattttttgggtgaattttgaagatagattttttttaaaagttagagattatttggttgagttttaggttagattgatacggagagtttggcggtatagtttaatcgtttattgttatggttagagggattttgtataattaatattgaagagtgtgaaattaaataagattttaagattggtaatcggtggtaaatattagtataaaatacggttgattttatgttatatattttttttttttagggtttttttttgaaagaataagtaagaaattttaatcgagataatttttgatgttttttagatttaaaattttacgtcggtattgggttttttttttttgttttacgtgagttatgtagtatttttagtttttttattaggattttattaatgtttttcgtattggaaatttttgtgttagaggttgaatttatagtaatttttaaaattaattaagaagaatttagttagaggttatagtaatgttggaattataaaatgtataagatttatttttttttggttttttttttatttatgttgtttatgtttgtgtatttataagttttatgtatattaaatttttaaaattaattattattatgttatagagtttttattggatagtgttttttagtttttattatatatttttttttttttatgtagatttattatgttggtgttttgttatatagggggtttgagaagaatgttatttaatcgtcgttgttgtgagtgtgtaaagtgattaggagattaggagaatgttgaaatttttgttggaaaaatgtaaagaaaatttttattttgagttagttgtttatagagttagtgtgtgtgtgcgtgtgtgtgtttgtaatataaaatggatgtgaatatatatatataaatagatatggttttgtttttattttaatttgaattatttagataattgtttttatttattatttgattttaatgggtttatataaattaggatattttatttttttaggtatttaggttgttgttgatttttagtgtttttaatatttcgtatacgttggtattatgaggagtagttacgtgtttttgggttttttaattattttggaggttgattgaggttttttatatatgtatatttgtcgtgatgaaagttttatcggtagagtggagttattagagtttttattaaaattttgtgggtttatgagagatgggtttagaaatttatatggttttgtggggtttttcggttttttaaaataaggtattaatatttaagtttttaaaaatatttgtagttttggggtttgaattttgaaaaataaggagtgaggggttgtgtatattaattatagtggagattttttttattttttaatgtgatggagtttttttatgaaatgaagttttaaggggtatggtattgtggggattatagttattttgaggtttaaaagaagaaattggaatatgattagtaaatatatttagtagaaaagagttggatttttattgatttagttataggttatcggttggtagtgtaatgggaggaaatatttattttatatatatattttatgattttgggggaattagaggaaatttaataagaaaacggttagaaatatttaaaatttttatttaaaagatttaagtaaattagagttttattagattaaaaattattataaatgtaagagtattgtttttagtgaaacgttgtggggtttgagaaggagatttttcgttaaattttcgggataaaatgcgttatttaagtattagataatgagtagaatgtaaattaatttaattttttttattaataggttgttagtgtaatgtgtataatttagtgataagattgtaggatttaatatagttggatgtatgagttttagttaatgtagatttgttatatgaggatgtgttttattttgagtaggtgtttgtatgtgtggaatggggtaaagtggaataaaaggttaaaagtagaaatgttgatttaaagtttattatgaagaaattttttttttgtagttaaattatttttaaagtgggatgatattggtgaagaaagattgaaaaataatttttatgtgcgtttttggattgtaagtttaaaatggggaggagttgtagatagggtttgggggtggttagggtaaaggagagatatataagttgtaaatatatttgtagtttgttttatttattttgttttatatcgaataagttttttaattttgtgaataaggataaggagggagtgttttaaagatattttatgttggtattgtaaattattgattgtaatgttaaataaatatatatttagagatgataatattaattttatagtaaaataatcgtttatgtagaaatttagaggagattagtttgttttttttagttgatttatgttgggggataaaaggatttttaaaaattattttgaatatgtttggatttttttttttaatttttttggaaattaaatttgtttggaaatagtgttataaagagttgatgtttttaaaggtgattttttttgttttatataaataaggttttgtttttgttagttgagcgtagttttaggtttttcgtttttagtttatatatattttttttgtttgtttggattttaatggtttaagatagttttgagtttattgggaaaagaaaatgattgttaaaaattatttttgaaattggttatttggtaatatttttaattgtatggaaatttattaaggtatattttatatataattagtttaaggttgttgattttataggttttatggatttaaatttgattgataataaagtaaataagagagtcgaatttaaagcgtggttttttcgggttaggacgagtttaatatagtgtataaggaatttgaaagatttaggatatgtgttttaattaacgttaagtagaatggataagtttttagtattttgaaaacgttgggttagggttttttttttattgtgtgttttttgtttggggattaataagtattatagagaacgtgatttgaggcgattttttatttttgtataaatttagagtgaattattaaatagttgttcgtttaaagttaaggtaatttttttttgacgggtttatttgtttttcgatttttaatttattagtttgtttttttagggttttgttttttttgtaattaaagtttttttagattagcgtagtatttatttgataggttgtttggaaaatttaagatcggagaggtgatttgttgttgttttttaaattttttagttttaagtaacgtgttttttttttatatggggtgggggattggaaatggatgtagtgagatataaagagtgggtgttttgttgatttttgtatttttttttttttgattattttattttttttttttaagttttcgatttttagttttatttttttatttttgggttcgtattaaaagtcggatcgttttgggttgggtaggagttgaattttcgggagtttgtttgtgtagatttagtgcgtacggcgaggtagtagttcggtttcgtattgttgataggtgtaggtaggatagtttttttatcgcggttcggggcgttttgattggtgcggagttacgttagtcgtattcggagaagggtttgggaggaggcggaggcggagagggttggggagggtcgcggcggagtgacgtttcggtattaggaagttcgtttttggttttaagatgttaggttaatagggaagcgcggagtcgtagatttggttcgtcgttcgtttgggtgtttggagttgagttgcggtaaggttcggtttttgttcgatcgttcgaggggtgtgcgtgtgcgcgttgcggagggtgcgtttagagggtcgcgtcgtggttgtagcggttgttgtcgtcgtaggggatttaatattatttatttgtttttgttatttttgatatttttttgttagggttgtcgcgtggggggggggcgggtagagcgcggtcggcgttagttttttttattggaggggtttttgggggagggagggagagaagaagggggtttttgtttatttttgtttcgttttggagtttggaagtttgttttttaaagacgttttgagtggtgtttttttgtttatattttatgttttcgtttgttcgttgatttttcgttttcggattttttcgtttgagtttttcggaggagacgggggtagtttggtttgagaattcggcgggggttgcgttttttggtttttttcgtagcggggaaatttcgcgtttagagcgcgattcggagcgggtagcggcggttacgggggttcggcggggtagtagttaaggattagtagagcgtcgcgttttttcgtttatgaattgtatgaaaggttcgttttatttggagtatcgagtagcggggattaagttgtcggtcgtttttttatttttttgttattatttttagtcgttagttatggtttcggttttggttttcggttagtttcggtcgttggatttttttaagtataggttggaggtgtatattattttcgatatttttagttcggaggtcgtaggtaaggcgtcgcgtcgttttgtagatattttcgtttagttgttttgcgttattcgttttttttcgttttaaggaagttagttttttcggggggaggcgtggtgggagtggtcgttcgtttggtttttcgtagaattttcgggagtcggaattttgattatttcgtatttttttagttttttttcgatcggttcggtttttggggcgttaagggcgcgagtaattttgtcgttttttttattcgtattttggttttttttttgttttttgggttataaaaattttagtattttgattcgaggatttttagaggtcgtcgatttttgtttttgtttttttttcggtttttagttttcgaggagttttattcgttaggaaattgtttgaaattatttagaaatgtttttcgcgaagaggtattttttttttttttttgggaaagggtcggcgaatttcggtgtttaatcgaatttttatatttttttttagtttttttaaatcgtatggaaatttgagttttttgcgagggggaggggggtttgtaaattacgcgcgtgtgcgcgttttaggagatttggtgtgtttgcgtagaggtgtataaatatatttgaaagtataggttataaaagtgaatgtgtcgttgtagtgagataaatatgtaaataaaacgtgcggcgttgggggaggggaggaaatggggcgcggatatttatatttgcgtttgtatattttataggcgtagcgtttttcgcggttcggagtcgtcgcgcgtattttttttcggcgttaggtagtttagtttttttacggtttttgtcgtcggtttagttggcgttcgcgttgtaggtgggtatgttgacgggaaagtgtgtgtgtttcgtttttagagaaagataaaagttagtaggggaagaatgaggacgtgggcgtcgaggattcgtttaagaagaagcggtaaaggcggtagcggatttattttattagttagtagttttaggagttggaggttattttttagaggaatcgttattcggatatgtttatacgcgaagaaatcgttgtgtggattaattttacggaagttcgagttcgggtaggagttagtacggagtttgggagggatggggggaggatgttgtggaggtataggttaagtagattaggagagaatgtggaaggtagcgtcgtttgggagggcgtcggtggggcgtagttttgtaaaggtagaaggtttcgcggcggtttggttgcgagattatagtttttttttcgaggtcgataggattgtcgttttggtttaggtttttagagcggtatcggtttattgtttcgttatttcgcgattttacgagttgggttgtatgggtaattttttgtataggatattgtgtttttggtttgtagttgttagagtagagttaataaaatttttattaggttaagagtcgcgaataggttttaatttgtgagtttttaataaggaaaattcgttagagatacggaagagttggttttttttgggaaatttttgtttcggttttggtttagtttttttttttttgggttcgcgttttttatattttttttacggttgtttcggttatttaggttttttttatatattttattttttagttttgtgattttcgggagtaaagttttaatatataattattagtttttttagaaggagaaagaaaaaaagaagaaagatttttttgtttggtttatttatttttttttaggagttgaattttggaaattgaaatttatatttttttttttaaattataattatagttttgtaaaaagggtttattttaattttgtagtaaatttgtattttatggattggtaaaaatgagtttaaataaataatttaatagtaacgttttggtttatgttggtcggtggaagattttaaatttgttaggattttggaagtagaaaatagaattaagtaaattaagcggtatttagaggttttgttgttaaaaaaaaaaaattaagtgttttgggtagaaaaaataaagttttcggttagagtagagtaaataaaaagaagaaaataacgataaaaagaataaagattaaaatgtttttttaaattagagggaatgaagatattttttgggtggtatttgtgtaaggtatgaggttatgttggtggataaaaggtcgggaagaagttgaaaatggttttagtttaattgtttagagttagagttgggttttgggcggcgtggttttgagtaaggttagttttttattagtttttttgtatattaagggaacgggttttttacgtatttttttcgtttgagtaaagtttagatggtttagggtagaaatggtaagtaattaaagatagagtttatgggttttttgggatttttcgaaaacgtttttttatttcgttcgttatttcgtagttttattttagtgttttgtagtcgcggcgttgggttttttttgtagttgtttttttttttagggcggttgtttgtcgagttaagtgggagtgaggcgtgttttttatagtagtcgggtgtaaagaggaagggggataaaaaggaaattaagaatgaaaggaaaaagagaaaaagcggattatacggttgggttcggcggagatgtgtaatgtgaaatattattggtgttagttcggatattttaggttaggtttttttttaatatataaaagtcgtcgtttggggcgatagggaggttcgatgtggattgggatcggggttgcggttgggttatcggatacgggtggaagtcggtcggtttgggtggtcgtttgtaaagttaaacgattcggttgggtttggcgcgcggataggtttgtggtgggtttagggtaaagaagaggtagagcgaaagaagggggaatttttaaaattatttttttcgggttttcggagtttaatatgttaagtttttggagttaacgagttgacgaagaggtggttttttgttttttatttggttgttttgttaggcgagaaagagtgttggcggtttagtttttgttaagggagtacgtattagggggtgggggacgatagtggaggttagggaaggaagggaggaattgcgtgggagaaagagcgattttttagtgtttttttagttttttttttttattcgtgggtttgtggttttggaatggaagtaagtttgtaaggtgtttcgggaagggttggaaaagtttgttgtttcgcgtttgttttatattaagtgtttttggatttggagaaacgtttggttgagtgattaaatcgttcgtaggtttttatgcgttcggttgaggtttgtggcgtagtttcgagttttagttcgtaggttagagtagattaggttttttgcgtttggtggagattcgggttagtaattgaaagttggttttggtattttggtgtgtagggcggtgtagtgaagcgaggttagggtgtgtgagtgcgttagcgtgtgtgtcgggggaaggcgggggttggttttcgatggaagttttagtaatttgtattgtggtatttgtttgtttttttgttttaatcgtttttaggtttggtttaagaatcgtcgggttaaatggagaaagagggagcgtaattagtaggtcgagttatgtaagaatggtttcgggtcgtagtttaatgggtttatgtagttttacgacgatatgtatttaggttatttttataataattgggtcgttaagggttttatattcgtttttttatttattaagagtttttttttttttaattttatgaacgttaattttttgttattatagagtatgttttttttatttaattttatttcgtttatgagtatgtcgtttagtatggtgtttttagtagtgataggcgtttcgggttttagttttaatagtttgaataatttgaataatttgagtagttcgtcgttgaatttcgcggtgtcgacgtttgtttgtttttacgcgtcgtcgattttttcgtatgtttatagggatacgtgtaattcgagtttggttagtttgagattgaaagtaaagtagtattttagtttcggttacgttagcgtgtagaattcggtttttaatttgagtgtttgttagtatgtagtggatcggttcgtgtgagtcgtatttatagcgtcgggattttaggattttgtcggatggggtaatttcgtttttgaaagattgggaattatgttagaaggtcgtgggtattaaagaaagggagagaaagagaagttatatagagaaaaggaaattattgaattaaagagagagtttttttgattttaaagggatgtttttagtgtttgatattttttattataagtatttttaatagttgtaaggatatatatataaataaatgtttgattggatatgatattttaatattattataagtttgttattttttaagtttagtattgttaatatttaaatgattgaaaggatgtatatatatcgaaatgttaaattaattttataaaagtagttgttagtaatattataatagtgtttttaaaggttaggttttaaaataaagtatgttatatagaagcgattaggatttttcgtttgcgagtaagggagtgtatatattaaatgttatattgtatgtttttaatatattattattattataaaaaatgtgtgaatattagttttagaatagtttttttggtggatgtaatgatgtttttgaaattgttatgtataatttattttgtgtataatatttcgtataatattattgttttattttttagtaaatatgaaataaatgtgttttattttatgggagtaaaatatattgtatataaattggtttggattttttttttttttttttgttattaatttggttaggatattttagttattgttttttaaataaattagttttttttgtttgtttagttaaatatataaggtagtagtttttatttaaatttggtagaaataaatgatagttatttattagaaattaaaaagaaaaaaaaaggtattttcgggggggaaaagggttataaaatttaattttgtttttttaatttttttttggtttaaatttagaggattttattatggttagtaaataatatgaaaaagaaaaaagaagaaagaaatttagtaagtttattagtttaaaatgatttttaagtttatttttttacggggaaatttatatttttagtaaattgttttggagaaatatttgtgtatgtatatatgtatagtttatatgtattttttttaggaggaatatatttataataaatttatagggaaatatttttagtttaaaatatttaggtttttacgtttatttttaggtttaagtagagagattttttatgttatattgtattattatttttaaattttttggagatattaaaagaaataaagatgatttttaataattatagttttttagttttttaaagaatttaggggttgagaggttagagtggagttttttgagttttgtcgagtaatatgtagttgaggtaaaggttatgttttcggtgttttgttttaaataatattgatttattaattttaaatttgtttgtttttgaaattatataggattatagtttgtaaattgtaggataatgaagtaaattaagatgaattatagttttggttttttttgttattttttgatatttaaatagggaatgagttcggtgtgagtgtttaaatgaattttaagtattcgatttttttttattcgcgatttttagttttaaaaaaatgtgaaatttgattttataataaatagaaataaatattatttagttttagagaatttatttttatggcgttaggagggtcgttgtggaggtggggggagggatgtgttgagattttttgttatgtttgttaatttttcgtataattaaagtgggcgagaataaatattacgttggggaatttagagtaaaaagtaatcgtcgattttttggagtcgataatattattgttttttcgttttagttgtttttatttgaatgaaattttatttagaagtttttggagttcgaatattgagtttttgttttgtaagaaattgttgttgttatttaaagagatcgtagataatgttttcgatttaagattagtgtttaacgtatattttttttttttttaaagttttgttttcgatttgcggagggattacgtagtagtggggggtagataaaagttttttggacgagggttattttttattatgttgtttatttgagagtagtggagaggaaaacggtttttacgggcggattttggtttttggagtcgtagggtttagcggtttcggttttttcgttttttagtttggtagggggcggggagggttaaagggcggaggggaaggaaggagttagaagaggggatttggggatgggggttggaagcgttaacgagatttgttcggaggatttaggttttttgtaggttggtgagtgatttgggagttttgggtaaaagaggtgtatttcggtttagtttggttgttgaattagaataacgcgaggatattaattaatttgtaggaaataaaaaatggaagtcgaggtttaggaagagttgttattttttcgatttgagtggtgtaggttgggggcggagatttgggatttaagagaggttattttttttattttagttttttttttttggatttttaaaaggaataattttattttttttttcgttttttttataatttttattttcgttagttcgtaggtcgtttgttttttttcgtattttttttttttatttagcgagagaaatttagtttttagagt

SEQ ID NO: 1134 - DNA, 8252 bp, Artificial Sequence
  chemically treated genomic DNA (Homo sapiens)
gttatcgtggttgggttataggtttattgttttgtggtagatggaagatatgggttttggtaatatattgaaatgttataggaaattaaattagaagtgatttaatttataagtatatttaggtttatttaatatgatgttttaaggtgggtggggggtttaaattagtagtttagggttattaaggttttaggttttgggttttattttattattatataatggttgtttgtaatattatattatatttattttttataatatttaaaggtaggttgtaagggttggtttaggaagttagagggcgttttttatttattaagggagaagtttgttttatttttaaggagatgttttttatgttttatgggttatatagaattgtacggttatttttggttaaaagaggggttgggaaagtgaatttttttttttttttttttcgtagagtgtaagttaggtaagaaagaacggatggtggatagttaggaaatagttagttacgagatgttgtgtggaaagtttatttttttgatattggagaattgtgggaagaacggataggttatatattagttgggttttgagaatttttagtttttgttttatagtgagttagtaggaatttaaagggtatgggtagattttaggggtttttttattttatttaggggtagagagggtaagacggagtagagcgaggtaagagattgagtaatgcgtttttaaagattgtgattgatagaagttgtgtaaattattatgataaattgaattttaagaggaattggattaaataaagttagtttatttttatttgtaattagtagatagagagtgtaagattagatatattatagatggaaaagaaaagttaaaatttttttgtatatttgagaggtaagaggaggtgtttgtggtttttttgatatatacgtgatatatgtattattacggtttatgtgtgtgttgttgtgtgtagggggtagggggtttttcgtttttgatggttttttttggtgggtgtttttcggttttttaggtttttttatttgttgaacgtggtagttaagggtttgggaatgatttgttagattggttaatgtggaaagagttggtttcgtttagttttgtatttttttttttttttttggaatcgtttggttgtagagagtaggagttttttagagttttcgggggattttatttttagtataattgtgtaacgtgtgtttagtataagagtattagatggagggataggtgggaggaggaggaatttagggtgtatttagtttggggtttgttgagttgaggtttttagagtaaggacgattaggttggggggatatttttttttaatttttgttaagttatagaggggttagtgggaataaagtgatattttggtttttgtattttttttttgttgttttattttttagttcgtttagatttgaggttggggaggggtttttttggaggggttagtttatgttattttttgtaatttttattatatatgtttttagatattttgttataggttttattttttacgttaatttttatttgggaaagtaaataaacggaaagttaatttgtgttatttggtcgttggggtattcgtagtgagtagttaagaaatgttaggggagtcggtgtttatttttatgtttggataagagtgcgttttggatttgcgttttgttgtatattttatcgtttcgttgtatattttatcgttttattgtatattttattgttttattgtatattttatcgttttattgtatattttattgttttattgtatattttattgttttattgtatattttattatttttgttttttgtatttagttgtttatttgtattttagtttaggaagtttagaagatgtagaatttttgcgagagtttagggtgaaacgttgcgttttatttttaaagaaaggaaaattatttatattttttaaaagaatgaatagtatagattaatatcgattttttttaatttttaggttaattttgagtagttaaagttagagtagttaatttgtgttgtgagtcgaggtatagttgtagaagcgtgtttgaggtgttcggtggaggtggtagtcgagttttgggattaattatcgtgttggggacggtatcgcgttaggatgtaggtagatttttgtagaagtgtttaaaatttatatttttttataggggtgagggggagggagaaagagatgttttagtgaggataaatatttttttttatatttaaataattatagagtttttattttaaagtatttataggtatattttttagaaaatatgaattgttagtcgggtacggtggtttacgtttgtaattttagttttttgggaggttgaggcgggtagattatttgaggttaagagtttaagatcggtttggttaatatggtgaaatttcgtttatattaaaaatataaaaaaaatttagttgggcgtagtggtatatatttgtaattttagttattaggaagttgaggttgaatttaggaggtagagattgtagtgagttaagatcgtattattgtattttagtttaggggtaacggagcgagattttattttaaaaaaaaaaaaaaaaaaagaatatatgaaatgtttttagatttcgttatgttttttttttttattttaggtaagttagaaagcgttattaatagtggttttttttaggtttttggttagagatgtgaagagaagtcggggggaaattaggtttttttttaagttttttagttttgtttttttatttttggatttgaatgtagtttgatttaggttattttattgtattattattggcggtcgtgattttgtgtaaaggtatagttggtgatgttgattagagtttttgtagttttaaatgatttttttaattaattttaaatttttagaatttatcgtataaaaaggttatattttttggagggacgtcgatggtattaggatagaagtattaggggattttacgaacggtgtcgtcgaaatagtagtttttatttgtatattgggagggcgtgatattaggaaaattataattttgttttttacggggggttattgtatacgtttttgaaagtgtataggtaagaagtaaagtaagttgtgggttgaattttttgatgttattatgtatatatttatttagtttttttttttaatgatattagtaattgtttagtgaggcggatataaaatttttaggatatgagagggagacgtggtttttatattttgatgtgtaaatattacgtttagggaaaatgtaaggtgttttaggtttgtggattttgtatttttttaggtaatttatttatttattttttaattttaataaatgattattaaattttatttaatatataaatatttattgagtattatttgtgtgtatgagaagtgggagttagtatggtaaaagttaggtattgtgttaggtgagagagatttagaaattaaaattagagaagttattaataagagtttaaatatttgggtttaggtttatgtttgtaattttagtattttgggaggttgaaggaggtgaattatttgaggttaggagtttaagattagtttgattaaaatggtgaagttttatttttattaaaaatataaaaaattaggcgggtattgtggtatacgtttgtaattttagttatttgggaggttgaggtaggagaattatttgaatttaggaggtagaggttgtagtgagttaagatcgtattattgtattttagtttgagtgatagagtaagattttattttaaaaaaaaaaaaaaaagagtttaaggatttgatggaggagaaaggtaagaatatgtgcgagataacgtaaggttatcgttttagggtgtttagggtaattacgggggtagggtatttttcggagaggttaatgataagtaggttgaataaagtaggggggttttttgtaggaggaggtttattaggtgaagatggagtcgtatgggtaaaggttattttagagatttaggtgtgtttaggaggtggaaatttattgtaggtaaggtgagaggatcgggtggggtggtttaggaggagtcgatagagggtataagttgtgaaatagtttgaagtagggtagtgaggaaagggatttagaggaggaagatacgtggatagatggggttggttgggggttgtcgtaggattttatgtaagaggttttaatattagagttttaggttttgagtttcgcggaattaaaggttttagaaagtaatttattaggatttggtggttgatagtttgtagtagggggtgaaagaggagtttagagtatttttcggtttttgtttttgttttggggtataggaggggaggaatttagtttggttatattggtttaggtgagggcgttttaggggaggtcgagaggggttgtttttttgtttgttttgttattagggattgtttcgagatgtttttggagaaagtgtttttggtttgttgggaaggattcgtgtttagttttcgttgtttagtagtttttatgggaattttgtttttttggggtttggatttatcgcgacgtgaaggtgattatcgtttattttcgggatattgtgggggttaagagaggtttcgtggtgagggaggattattattttgggggtcgggggggttttttttttagggaggaagatttttagtttcggtgttttgttttcggtagattttgttttgtttattcgttttgtttttgtcgtatgatggaaataaatggaaatggtttttatatacgaatgtattaaattgtaattataattttttagattttagttgtaataggattatggatttgagtgattcgtaaagacgttttgagttttgagttagagggtgtgtggggtggggaggggagtttgttacggtttttgtgattttatagtatagggggtagagttgggggttggggtgggggtaagggcgtaggtagatgggtttgggggtggttagtacggggatttatttagttcgttttgtatatcgaggttattttttttttcgggttttaaagttttttcgttttttgttatgggtttgggggtttttttattgtagtttaatgttggttgtttttttacgttgtttaagtttattttttaggttcggtattttatagtagagattaagaggtggttggagggtagtgggggtacggatagtattattgggcgttttttttttaggtttttttggaaatttttgttttggaaacgtagaaagtttttttttttgtttttattttgaaattgtatttaataacggtaaataagttatttagttttttatagttggtaaagtgtaagtcgtagatgttgttatatagtattttttgatagttttagggtagatcgttgatttattttgtaggtaaaggagttgagatgtaaatattttttaaggaagtaagaatggtttttttttttattttttagaaggatttagggtaatcgatttatttgataatattagggaatatgggttgttagttacgtatttatgagagaggtggttttgatttttagagtatggattttaggggagtttaggaatttgtaggagagggttttttagttggttattattgggacgggtattcgggtttgtgggagagggttttttaggtggttattattgggatcggtatttgggtttatttggatgggttttgggagggtttgtttttgggggagatgttggtatgaatagttaaaagtattattttgagattttacgttaatattttttttttgaaatatgatatttgggaggattgtatagtttttttaatataggaaaatagtttcgattgaaggtagtttttttttcgtcgtatttttcgaaggttttcgggggttttgttattttgagttattttttatttgtttttgtcgattttgtaaattggatatatttttaagggtttagaatagtatttggtataaaataggtgtttaaaaatatgtatgtaaaatagtggtttttggcggaggttgttagagttggttgtggttttatagagtaggaagaagtacgttttatttgtttgggtttcggttagggtgtcgagggttagtatggatattaggattagggcgtagattattttgttttttatggtggttattgttttttttttgttttaaaggcgatttcgagttagggatgagaggtcgttcgagtttcggattttatagggtaggttttgtttgtttaaagagcgttagataatatttgtttaaggaggttcggggattttttgagataataatttttattgatttttattaaaggtgttttttagatatggttaagttatatggaaggatttgttgatagatagagacgatatgtggtgaggttattttggttgagggatttgagatttagaaagttttttttttttatgggagttttttttaatttgattttaatttaggttttatttatatttgagaggttttttcgttagggtaaatattgtatttattgtagaagtgatttatagtgagagatggtcggaaaaaggtttggtcgtgataatagtggtttacggggtggttatcgtgattttgtagggggaagggaaggagtttatgaagtttatttcgtttaggtttaagttaatttttttatagtggaattgttttaataatgaaattgtaggtttggcgtagtggtttacgtttgtaattttaatattttgggaggttaaagtaggcggattatttaaagttaggagtttgagattagtttggttaatatggcgaaatttcgtttttataaaaaaaaaaaatataaaaattagttaggtatggtggcgggtgtttgtaattttagttattttggaggttaagttaggagaattatttgaatttgggaggcggaggttgtagtgagtcgagattattttattgtattttagtttgagcgatagattaagtttttttttgggaggggttgggggtaggagggagaaaaaaatagtatatacgagttgttattaaaaattgataaagtgaacgtggtttatttttttgtgtttatggggtttttttttttttttttttatatttttttagttggttttttggatttttgtattttagaggatagttttttgtttttttgtattatgttttattttttttttttgttcggagtttttttttttatagtttttattattttttggtggataaaataagtgattgatatattatgttggttatttatttattgtatttttttttgtagtagacgggagggcgtatgggagtagaagtttttattttttagtgttttgaggtggttttagattttagaatagtggttttgattggtattcgagaaatagttgttgaagagttgtatgaagaaatggataataggagaaatttttttttttttagtgagaaattaggttttgaggaaaatgtatgttagtttaataaaggtattatttttttttgggtgatttagttagtatatttttgtagtttttttgggaggggagtttgggttagaatgggggcggttatgttttttttcgttttattttaggatttagttttttttttagggttgttatttttgtatcggggtttttatttttgggttagggtttttaggaggggtttgatcgtaggatttagggaggggtcgaggtttggtgttttttgtggttagtttaagtttattgaaaataggacgggggtattaggtttagggtggtgtttatagtgacggtggttttcgttgttttaatttttcggattaaaatgggggtttttggaaatgggatgtaaattgtataattatttggagaaaaggtgggtagtgttcggtgaggtttaagttatatagattttatagtttagtaaatttttttgtttttaggtttggttttttaattttagaaatatgtttatatttgggtagaagaaaatataggtaaagatattttttttagtattgtttgtaatagttggaaatagggaaagaaggaaggaaggaaaggagggaaagaaaagtaaaataaatatttattaattagggaaagggaaaatgaatttaaaatataatgtagtcgttttttagtatttttgggggattggttttaggattttttatttagggatgttaaaatttataaatgtttaagttt

SEQ ID NO: 1135 - DNA, 8252 bp, Artificial Sequence
  chemically treated genomic DNA (Homo sapiens)
ggatttgagtatttgtggattttggtatttttgggtggggggttttgaaattagttttttaggggtattaagggacgattgtattgtattttaagtttattttttttttttttggttaatgaatatttattttgttttttttttttttttttttttttttttttttttttttgtttttagttgttataaataatgttaaaaagaatatttttgtttgtgtttttttttgtttaagtatgaatatgtttttgggattaagagattaggtttggaaatagaagaatttgttgagttgtaaaatttgtatggtttaaattttatcgaatattgtttattttttttttaaatgattgtgtaatttatattttatttttaagagtttttattttgattcgagaaattagagtagcgaaaattatcgttattatgagtattattttgggtttggtgttttcgttttgtttttaataaatttaagttgattatagaggatattaggtttcggtttttttttgggttttgcggttaggttttttttggagattttggtttaggagtggagatttcggtgtaggagtggtagttttggaggaggggttgggttttgggatggagcgaagaggaatatggtcgtttttattttggtttaggttttttttttagaggggttgtagaaatgtattgattaggttatttaagaaaagatagtatttttgttaggttagtatgtattttttttagggtttaattttttattgaagaagaaaagattttttttgttgtttatttttttatgtagttttttaatagttgtttttcgaatgttaattaaagttattgttttagggtttggggttattttaaggtattaggagatgaggatttttgtttttatgcgttttttcgtttgttgtagggaggagtgtaatgaataaataattaatataatgtgttagttatttgttttatttattaggaggtaataagagttatgaaagagaaagtttcgagtaggggaggggagtgaggtatggtataggagagtaggaggttgttttttaaaatataggagtttaggggattaattgggaaggtgtgggagggggagggagggagttttatagatataggggagtgaattacgtttattttgttagtttttgatggtagttcgtatatattattttttttttttttttgtttttagttttttttagaaggagatttaatttgtcgtttaggttggagtgtagtagggtgatttcgatttattgtaattttcgttttttaggtttaagtgatttttttgatttaatttttagagtagttaggattataggtattcgttattatgtttggttaatttttgtattttttttttttgtagagacggggtttcgttatgttggttaggttagttttaaatttttgattttaagtgattcgtttgttttggttttttaaagtgttgggattataggcgtgagttattgcgttaggtttataattttattattaaaataattttattgtaaaagaattagtttaggtttagacggaatgggttttatgagtttttttttttttttttgtaaggttacggtggttatttcgtgagttattgttgttacggttaagttttttttcggttattttttattatgaattatttttgtagtgagtatagtatttattttggcgggagggttttttagatatgagtaggatttggattaaggttaggttggaggagatttttatgggaaagagggattttttgaattttagattttttagttaagatgattttattatatgtcgtttttgtttattagtaaatttttttatgtagtttgattatgtttaggaaatatttttgataaaaattagtggagattattgttttagaggattttcgggtttttttaggtaaatgttatttaacgttttttaagtaaatagagtttgttttataaaattcggggttcgggcggttttttatttttgattcggggtcgtttttggagtagagaggaggtaatggttattatggagaataaggtgatttgcgttttggttttggtgtttatgttggttttcggtattttggtcgaggtttagataggtaaggcgtgtttttttttgttttgtggggttatagttagttttggtagttttcgttaggagttattgttttatatatatatttttgagtatttgttttgtgttaggtgttgttttaggtttttaaaagtatatttaatttataggatcggtaaaagtaggtggagagtaatttagggtggtagggttttcggagattttcgagaagtgcgacgaggagggggttgtttttagtcggggttgtttttttgtgttaggaagattatataatttttttaagtgttatgttttaaagaggaagtgttggcgtggggttttagaatagtgtttttgattgtttatgttaatattttttttaggggtagatttttttaaggtttatttagataggtttaaatgtcggttttagtgatggttatttgggagatttttttttataggttcgaatgttcgttttagtggtggttaattgggagatttttttttataggtttttgggtttttttgggatttatgttttgggagttaaagttattttttttatgagtgcgtggttggtaatttatattttttggtgttgttaagtggatcggttgttttgggtttttttagggagtggaggaggaggttatttttgtttttttgggaagtgtttgtattttaatttttttatttgtagaatggattaacggtttgttttagggttgttaggaaatgttgtgtggtagtatttgcgatttgtattttgttagttgtggggagttgaataatttatttgtcgttattaggtatagttttaaggtgggggtaggagaaagggttttttacgtttttaaagtaagggtttttagagaggtttgaagagggagcgtttagtggtgttgttcgtgtttttattgttttttagttattttttgatttttgttgtggggtatcgggtttgaggggtgggtttgggtagcgtagaagagtagttagtattgggttgtagtgggaagatttttaagtttatggtagggagcgggggagttttggaattcgagagaggaagtggtttcggtgtatagaacgaattgggtgggttttcgtgttggttatttttaggtttatttgtttgcgtttttgtttttattttagtttttagttttgttttttgtgttgtgggattatagaggtcgtggtaaatttttttttttattttatatattttttggtttaaggtttagagcgtttttgcgggttatttaggtttatgattttgttataattgaaatttagaaaattgtgattatagtttagtgtattcgtgtgtggaaattatttttatttatttttattatgcgataaagataaagcgggtgggtaagatagagtttgtcggaggtagagtatcggggttggaaatttttttttttgaggaggaaattttttcgatttttaggatgatgatttttttttattacggggttttttttgatttttatagtgtttcgggggtgggcgatgattatttttacgtcgcgatggatttagattttaggagggtaaggtttttatggaagttgttgggtagcgggagttgaatacggattttttttagtaagttaggaatattttttttaaagatatttcgaggtagtttttgatagtaaagtagataagagaatagtttttttcggttttttttggggcgtttttatttgagttagtgtggttagattgagtttttttttttttatgttttaaggtagggatagggatcggagggtgttttgggttttttttttattttttgttgtaggttgttaattattagattttaataggttgttttttgagatttttgatttcgcggagtttagagtttgaagttttggtgttagaattttttgtataagattttgcggtagtttttagttagttttatttgtttacgtgttttttttttttagatttttttttttattgttttgttttaagttgttttatagtttgtattttttgtcggttttttttagattattttattcggtttttttattttatttgtaatgggtttttattttttgaatatatttgggtttttggaatggtttttgtttatgcggttttatttttatttggtgaatttttttttgtagggagtttttttgttttgtttaatttgtttgttattggttttttcggggagtgttttattttcgtggttattttgggtattttgggacgatggttttgcgttgtttcgtatatgtttttgttttttttttttattagatttttagatttttttttttttttttttgagatggagttttgttttgttatttaggttggagtgtaatggtgcgattttggtttattataatttttgttttttgggtttaagtgatttttttgttttagttttttaagtagttgggattatagacgtgtgttataatgttcgtttaattttttgtatttttagtagagatggggttttattattttggttaggttggttttgaatttttgattttaagtgatttattttttttagttttttaaagtgttgggattataggtatgagtttgggtttagatatttagatttttattaatgatttttttggttttaatttttgggttttttttatttggtatagtgtttggtttttgttatgttagtttttattttttatgtatataaatggtgtttagtaaatatttatgtattgagtaaaatttaataattatttgttgaaattaaaaagtgaataaataagttatttagaaagatgtaaagtttataaatttggggtattttgtattttttttgagcgtaatgtttgtatattaggatgtgaggattacgttttttttttatgttttgagggttttatattcgttttattggatagttgttgatgttattggagaaggaagttggatgggtgtgtgtatgataatattaaggaatttagtttataatttattttgttttttatttgtgtatttttagagacgtgtatagtggtttttcgtgaaagatagaattgtggtttttttggtgttacgtttttttagtgtgtaaataagggttgttgtttcgacgatatcgttcgtggggttttttggtgtttttattttaatattatcgacgtttttttagaaggtatggtttttttatacgatgggttttgaagatttagaattagttagaaaagttatttaagattatagaggttttgattagtattattagttatgtttttatatagagttacggtcgttagtggtggtgtaatggggtagtttgagttaggttgtatttaggtttaggaatagaaaggtagggttaagggatttgggaagaaatttgattttttttcggtttttttttatatttttaattaaaagtttgggaagagttattgttggtaacgttttttagtttgtttaggatagagggggaaggtatgacgaaatttgaagatattttatgtattttttttttttttttttttttgaaatggagtttcgtttcgttgtttttgagttggagtgtaatggtgcgattttggtttattgtaatttttgttttttgagtttaattttagttttttagtagttgagattataggtgtgtgttattacgtttagttaaattttttttgtatttttagtatagacggggttttattatgttggttagatcggttttgaatttttgattttaggtgatttgttcgttttagttttttagagagttgggattataggcgtgagttatcgtgttcggttgatagtttatgttttttaaagaatgtgtttatggatattttaaagtaaaaattttgtaattgtttaaatgtgaaagaaaatgtttatttttattaaagtattttttttttttttttttttatttttgtagaggagtgtgaattttagatatttttgtagggatttgtttgtattttgacgcggtgtcgtttttagtacggtgattagttttagagttcggttgttatttttatcggatattttagatacgtttttgtagttgtgtttcggtttataatatagattgattgttttgattttgattatttaaaattggtttaaaaattaaaagagatcgatattaatttgtgttgtttatttttttaaagaatatgaatgatttttttttttttgaaagtgaagcgtagcgttttattttgggttttcgtagaggttttgtattttttgggttttttgagttgggatataagtgggtagttgagtgtagaaagtagggatggtggggtgtatagtaggatagtggggtgtgtagtaggatagtggggtgtgtagtaggacggtggggtgtatagtaggatagtggggtgtgtagtaggacggtggggtgtgtagcgggacggtggggtgtgtagtaggacgtaagtttaagacgtatttttgtttaggtatgaaaatggatatcgatttttttggtattttttaattatttattgcggatgttttagcgattaagtgatataagttagtttttcgtttatttgtttttttaaatagaaattggcgtaggagatgaaatttgtagtagaatgtttgaaagtatgtgtaataaaaattgtagagggtggtatggattgatttttttaggaaaatttttttttaattttagatttgaacgaattagaaaatagaatagtagaggagggatatagaagttaaaatgttattttatttttattggtttttttgtagtttggtaaggattgggagagggtgtttttttaatttagtcgtttttgttttggggattttagtttagtaagttttaagttaaatgtattttgggttttttttttttttatttgtttttttatttggtgtttttgtgttgggtatacgttgtatagttatattggagatgggatttttcgggagttttggaaagtttttgttttttgtagttagacggttttagggaggaagagggaggtgtagaattgagcggggttagttttttttatattaattagtttggtaaattatttttaaatttttggttattacgtttagtagataaagaggtttgagaggtcgggagatatttattaagaagaattattaggaacgggaagttttttgttttttgtatatagtagtatatatatgagtcgtaataatatatatgttacgtatgtgttaggggggttatagatatttttttttattttttagatgtgtaaggaagttttagttttttttttttatttatggtatgtttgattttatattttttgtttgttaattataggtaaaaatgagttaattttatttagtttaattttttttaaaatttagtttgttataataatttgtatagtttttgttagttatagtttttgggaacgtattgtttagttttttatttcgttttatttcgttttgttttttttatttttgggtggggtgaaggagtttttggggtttgtttatgttttttggatttttgttggtttattgtggagtagaagttgggggtttttagagtttagttggtgtgtggtttgttcgttttttttatagttttttagtgttagaaaggtgggttttttatataatatttcgtagttgattgttttttggttgtttattattcgtttttttttatttaatttgtattttacgaaggaagggggagaaagaatttatttttttagttttttttttagttagaagtggtcgtgtaattttatgtggtttatgagatatagggggtatttttttgaaggtggggtaggttttttttttgatgaatgaagagcgttttttggttttttaggttagtttttgtagtttgtttttgggtgttgtggaaggtgggtgtgatgtggtgttgtaggtagttattatgtaataatgaggtaaggtttaagatttagagttttaataattttgagttattgatttgagttttttatttattttgagatattatgttaaataaatttaagtgtgtttgtgggttaaattatttttggtttggttttttgtggtattttagtatattattaaggtttatattttttatttattatagagtagtgagtttatggtttagttacgatggt

SEQ ID NO: 1136 - DNA, 28536 bp, Artificial Sequence
  chemically treated genomic DNA (Homo sapiens)
gttttgggagttaggttttttttgttggatgggaaaaggaggtgtggaaaggggtaggtggtttgtgggttagtggggatgagagttgtggggagaatggaggagagagtaaaattattttttttggaagtttaagggaagggagttgaggtgagagaaatggttttttttaggttttaagtttttgtttttagtttgtattatttaagttggggaagtgataattttttttaaattttgatttttattttttgttttttgtagattgattgatgtttttgtgttgttttagtttagtaattaaattaggttgaggtatattttttttatttagagtttttaaattatttattaatttgtaggagatttaaattttttgggtaggttttgttagtgtttttagtttttatttttaaatttttttttttagtttttttttttttttttgttttttggttttttttgttttttattaggttgagaggtggagaggttgggattgttgggttttgtggttttagaagttaaagtttgtttgtggggattgtttttttttttattgtttttaagtgaataatatggtgggaggtgatttttgtttaaagggtttttatttgttttttattgttgtgtgatttttttgtaagttggaggtagagttttaaaaagaaagaaagtgtgtgttgagtattgattttaaattggggatattatttgtgatttttttaagtggtagtagtagttttttgtagaataaagatttagtgtttgagttttaaaagtttttaggtaaagttttatttagatgaaagtaattaaggtgaaaaaataatgatattgttggttttagaaaattggtggttattttttgttttaagttttttagtgtggtgtttgtttttgtttattttggttgtgtggggggttgataagtataataaaagattttagtatatttttttttttatttttataatgatttttttagtgttatgaggatgaattttttgggattaagtggtatttgtttttatttgttatgaaattaaattttatatttttttaaagttgaaaattgtggataaagaaggattgggtgtttaaagtttatttaaatatttatattgaatttattttttgtttagatgttagaggatggtagggagggttagggttgtaatttattttgatttgttttattgttttgtagtttgtaaattataattttgtataattttaggaataagtaggtttagaattaatgggttaatattatttaaaataaaatattgggagtatgatttttgttttaattatatattgtttgataagatttaggaaattttattttaattttttaatttttgagttttttgagaaattgaagggttgtagttattagaaattatttttgttttttttaatgtttttaaaggatttggaaatagtaatgtaatataatatgaaggatttttttatttaagtttgaagataaatgtggaagtttaaatattttgaattggagatgtttttttgtaaatttattatagatgtattttttttgagagaaatgtatataaattatatatgtatatatgtataaatatttttttagaataatttgttagaggtgtaggtttttttgtaaaggagtaaatttgagagttattttaagttgatggatttgttaaattttttttttttttttttttttttatattatttgttagttataatggaattttttaggtttaagttaaagaaaaattggagagataaaattagattttgtagttttttttttttttgggaatgtttttttttttttttttagtttttgatgaatggttattatttatttttattaaatttaaataaggattgttgttttgtatgtttaattaggtaggtagagggaattggtttgtttaggaagtagtgattgagatgttttggttaagttagtgatagaggaggggagaaagaatttagattaatttgtatgtagtatattttatttttatgaaataaaatatatttgttttatatttgttgaaaagtaaaataataatattgtatgaaatgttatatatagggtaggttgtatatagtagttttagaaatattattgtatttattagagaaattattttaaaattgatatttatatattttttataataataataatatgttagaaatatatagtgtggtatttagtatatatatttttttgtttgtaagtgaaaaattttaattgtttttgtataatatgttttattttaaagtttaatttttaaaaatattgttgtgatattattaataattgtttttataaaattaatttgatattttgatatatatatatttttttagttatttaaatgttaataatgttaaatttaaaaaataataagtttatagtaatgttaaaatgttatatttagttaaatatttgtttgtgtatgtgtttttgtaattgttagaaatatttgtagtgaaagatgttagatattgaggatatttttttgaaattaaaggagttttttttttgatttagtggtttttttttttttatatagtttttttttttttttttttttttagtgtttatgattttttagtataatttttagttttttaagggtggagttgttttatttggtaaggttttaggattttggtgttgtgggtgtggtttatatgggttggtttattgtatattggtaagtatttaggttggaggttgggttttgtatgttggtgtagttgaagttggagtgttgttttgtttttagttttaggttggttaggtttgagttatatgtgtttttataaatatatggaggagttggtggtgtgtaaggataggtaggtgttggtattgtggaatttagtgatgggttatttaggttgtttaagttatttaggttgttgagattggagtttgggatgtttgttattgttgagggtattatgttggatgatatgtttatggatgagatagagttgggtggggaaaatatgttttgtgatgatagggggttgatgtttatagagttgaagaaggggaagtttttggtggatagggaggtggatgtaaggtttttggtggtttagttgttgtaggaatagtttgggtatatgttgttgtagggttgtatgagtttattgaattgtggtttgaagttatttttgtatagtttggtttgttggttgtgttttttttttttttatttggtttgatgatttttgaattaaatttgggggtggttggggtaagggagtaaatagatgttatagtgtagattattaaaatttttattggaggttaatttttgtttttttttgatatatatgttagtgtatttatatattttggttttgttttattgtattgttttgtatattaagatattagggttagtttttagttattggtttgggtttttattaagtgtaggagatttggtttgttttggtttgtgagttgggatttggagttatgttataaattttagttgaatgtatggagatttgtggatggtttgattatttagttaggtgtttttttaggtttaaaaatatttaatgtaaaataaatgtggggtagtaggtttttttaattttttttggggtattttgtaaatttgtttttattttaaagttatagatttatggatgaggagaaggggttggaagggtattagaggattgtttttttttttatgtaattttttttttttttttttgatttttattgttgttttttattttttggtatgtgtttttttaatagggattaggttgttaatatttttttttgtttagtaaaataattaaataaagagtaaaagattatttttttgttagtttgttaattttaggagtttggtatattaaattttgggaatttggaaagggtagttttggagattttttttttttttgttttgttttttttttattttaagtttattataggtttgtttgtgtgttaggtttagttgggttgtttggttttgtaggtggttatttaggttggttggtttttatttgtgtttggtggtttagttgtaattttgattttaatttatattgggtttttttgttgttttagatggtggtttttgtgtattggagagaggtttggtttgagatatttgagttgatattagtgatgttttatattatatatttttgttgggtttagttgtgtaatttgttttttttttttttttttttatttttgattttttttttatttttttttttttttgtatttgattgttataaaaagtatgttttatttttatttggtttgataagtagttgttttggaaggagaggtagttgtaaggagagtttagtgttgtggttataaagtattagggtggagttgtggaatagtgggtggggtgggagggtgtttttgaaggattttagaaaatttatagattttgtttttaattatttgttatttttattttaggttatttaaattttgtttaggtgagaagagtatgtgagaggtttgtttttttgatgtgtaagagagttaatgaaagattgattttgtttaaaattatgttgtttaggatttagttttggttttggatagttaaattaaaattatttttaatttttttttggttttttatttattagtatagttttatgttttgtataaatgttatttagagagtgtttttattttttttgatttgggagagtattttggtttttattttttttattgttgtttttttttttttgtttgttttgttttaattgggggttttattttttttatttagagtatttaattttttttttttaatagtaaagtttttggatgttgtttgatttgtttgattttgttttttgtttttagaattttaataaatttggaattttttattgattagtataaattaggatgttgttattgggttatttatttgagtttatttttgttaatttataaagtatagatttgttataaagttaaggtaagttttttttataaaattatgattataatttagaagagggggtgtgagttttaatttttagagtttaatttttgagagaagataaataaattaagtagaaaagttttttttttttttttttttttttttttaagaggattagtagttgtgtattaaaattttgtttttggagattataaaattaggaaatagggtgtgtgggagagatttgaatggttgaaataattgtaaagaaggtgtaagaagtgtgagtttaggagggaaaaagttgggttagggttgggataaaggttttttagggagggttaatttttttgtgtttttggtgggttttttttgttaaaggtttataggttggagtttgtttgtggtttttggtttggtagggattttattagttttgttttggtaattgtaagttaggaatataatgttttgtgtaggggattgtttatgtagtttagtttgtgagattgtgggatggtggggtagtgagttggtgttgttttgggagtttgagttagggtggtagttttgttggttttggagagggaattgtaattttgtaattaggttgttgtgaggttttttgtttttgtaaagttgtgttttattggtgtttttttaggtggtgttgttttttatatttttttttggtttatttggtttgtatttttataatattttttttttattttttttagattttgtgttggtttttatttggatttgggtttttgtaaggttggtttatatagtgatttttttgtgtgtggatatgtttgggtagtggtttttttggaaagtggtttttagtttttggagttgttggttggtaaagtgagtttgttgttgtttttgttgtttttttttagatgggtttttggtgtttatgtttttattttttttttgttggtttttatttttttttgaaaatgaaatatatatatttttttgttagtatgtttatttgtaatgtggatgttaattggattggtggtagaagttgtggaagagttgggttgtttggtgttggaggagggtgtgtgtggtggttttgggttgtgaggagtgttgtgtttgtggggtgtgtaggtgtaagtgtgggtgtttgtgttttattttttttttttttttagtgttgtatgttttatttatatgtttattttattgtagtggtatatttatttttatagtttgtgtttttaagtatatttatatatttttgtgtagatatattaaattttttgggatgtgtatatgtgtgtggtttatagattttttttttttttgtagaaagtttagatttttatgtggtttgggaaggttaggaaaagatgtggggatttggttgggtattgaagtttgttggtttttttttaaaaaaaaaaaaaaaatgtttttttgtgaagggtatttttgagtggttttaggtaattttttaatgagtggagttttttgggagttgaaagttgagaggaaaatagggatagaggttggtggtttttgaaggtttttgaattaagatgttgggatttttgtgatttaggaaatagaagggaggttagggtatgaatagagagggtggtagaattgtttgtgtttttagtgttttaggagttgggttggttgagggagaattaaagggatgtggggtagttaaaattttggtttttggaagttttgtggggagttaggtgaatgattatttttattatgtttttttttggaggggttgatttttttggggtgagagggagtgggtggtgtagagtagttgagtgggaatgtttgtagggtggtgtggtgttttatttgtggtttttgggttggaggtgttggagatggtgtgtatttttagtttgtgtttggaggagtttagtgattggggttgattgggagttagaattgaagttatggttaatggttggggatggtgataggaagatgaggagatggttgatagtttggtttttgttgtttggtgttttaagtgaagtgggttttttatgtagtttatggatgagggagtgtgatgttttattagtttttggttattgttttgttgagtttttgtagttgttgttgtttgttttgggttgtgttttaggtgtggagtttttttgttgtggggagagttaggggatgtaatttttgttgagtttttaagttaagttgtttttgttttttttggaaggtttaagtgaaaaagtttggagatggaaagttagtgggtaaatgaagatatgggatgtgggtagaagggtattatttagagtgtttttagggagtaggtttttaagttttaaagtgaaataagagtgggtaaagatttttttttttttttttttttttttttaagaatttttttaataaggaaagttaatgttgattgtgttttgtttgttttttttttatgtggtagttttgatagagaagtgttaagagtgatagggataggtaggtgatattagattttttgtggtggtagtagttgttgtagttatgatgtggttttttgagtgtattttttgtaatgtgtatatgtatattttttgggtggttgaataggagttgggttttgttgtagtttagttttaggtatttaggtgagtgatggattagatttgtggttttgtgtttttttgttggtttaatattttaaaattagaggtgggttttttggtgttgagatgttattttgttgtggttttttttagttttttttgtttttgtttttttttagatttttttttgggtgtgattgatgtggttttgtattaattaggatgttttgagttgtggtggagggattgttttgtttgtatttattagtagtgtggggttgggttattgttttgttgtgtgtattgggtttatataggtaagtttttgggaatttagtttttgtttagtttaaggtgatttggtttttagtatgaatttaaaggtgaagagatgaggttaggagttgaaggtttgggagaagagagtggaatggttaagaagagaaaggtataaggattaataagatatttattttttgtgttttattatatttatttttaattttttattttatataaaaaggagatatgttatttaaaattagaaaatttgaaaaatagtaataaattatttttttgattttaaattttttaaatagtttgttaagtgaatgttgtgttaatttgaagaagttttaattgtaaagaagatagagttttgaaaaggtaggttaataaattagaaattgagaagtaaatggatttgttaaaagaaaattattttgattttaaatgaataattgtttggtggtttattttggatttatataagaataaaaagttgttttagattatgttttttgtgatgtttattagtttttagatagaaaatatataatagaagagaaattttaatttagtgtttttaaaatgttgaaagtttatttattttatttaatgttgattaagatatatattttagattttttaaattttttgtatattgtattaagtttgttttaatttgagagagttatgttttaaatttgatttttttgtttattttattattaattagatttaaatttataaagtttgtagaattaataattttgagttaattatatatgaaatatgttttaatgaatttttatataattaagaatgttgttaaataattaattttaaggataatttttaatagttattttttttttttagtgagtttaaggttgttttgagttattaaagtttaagtaggtagaaggggtgtgtgtgagttaagggtgaaaagtttagaattgtgtttaattagtaaaagtaaaattttatttatataaaataaaaaaaattatttttggagatattaattttttatagtattgtttttaagtaaatttaatttttaaagaaattaaagaaagaaatttaaatatatttaaaataatttttgaaagtttttttgttttttagtataggttagttggagaggataaattaattttttttgggtttttgtatgggtgattgttttattatggagttagtgttattatttttgaatgtgtatttgtttgatattatagttaatgatttgtaatgttagtatgaagtatttttaaaatattttttttttgtttttgtttataagattgggaaatttatttgatgtggaataaagtggatgaagtagattataaatatatttgtaatttatgtgttttttttttgttttgattatttttaaattttatttgtaatttttttttattttaaatttgtagtttaaagatgtatatgagaattgttttttagtttttttttattagtattattttattttaagaataatttagttgtaagggaggaatttttttatagtaagttttaaattagtatttttgtttttaattttttattttattttattttattttatatatatagatatttgtttagagtaaaatatatttttatgtgataggtttgtattagttgaggtttatatatttagttatattaggttttgtaattttattattaaattatatatattatattagtagtttgttggtaaagaaggttaaattaatttatattttgtttattatttggtgtttaaatgatgtattttattttggagatttggtggagaattttttttttagattttatagtgttttattgaagataatgtttttatatttgtagtggtttttaatttgataagattttaatttgtttaagttttttaaataagggttttaaatgtttttagttgtttttttattgaattttttttaatttttttaagattataaagtatatgtgtaaagtaaatatttttttttattgtattgttagttgatgatttataattaagttaataagaatttagtttttttttgttgaatgtgtttattaattatattttagtttttttttttaaattttagaatagttgtggtttttataatattatgttttttaaagttttattttatgaagggattttattatattaaagaatgaaaaaaatttttattgtagttagtatatatagttttttattttttgttttttaagatttaaattttagagttgtaaatatttttggaagtttgggtgttaatgttttattttagaaagttgagaagttttatagagttatatagatttttaaatttattttttataaatttatagaattttgataaaagttttggtggttttattttattgatggaatttttattatgataaatatatatgtatgaaggattttaattagtttttaaagtggttgaaaaatttaagggtatgtgattgttttttatagtgttaatgtgtgtgagatgttggaagtattggggattagtagtagtttagatgtttaaaaagataaggtgttttaatttgtgtggatttattgaagttaagtggtgaataaagataattatttagataatttagattaaagtaaaagtaaaattatatttatttgtatatatatatttatatttattttatattatagatatatatatgtatatatatattggttttgtaaataattgatttaaagtgaggattttttttgtatttttttagtaggagttttaatatttttttaattttttaattattttatatatttatagtagtggtgattgggtgatattttttttaggttttttgtgtggtaggatattaatatgataagtttgtatggggaaaaggaggtatgtggtgggaattaagaaatattgtttagtgaaaattttgtggtatggtggtggttgattttggagatttaatgtatataagatttgtgggtgtataggtataggtagtatggatgagaaaggggttagaagaaaataaattttatgtattttgtgattttagtattattgtgatttttggttaagttttttttaattggttttagaaattattatgagtttagtttttaatatagaaatttttaatatggagaatattggtgggattttggtagggaaattagaggtgttgtatggtttatgtggggtaaagaaggaaagtttagtgttggtgtgaggttttgagtttgggagatattaggggttgttttgattggggttttttgtttatttttttaaagaaagattttagaggagggaaatgtgtgatatggggttagttgtgttttgtgttggtatttgttattgattattagttttaaagttttatttaattttatattttttagtgttagttgtgtaaagtttttttggttatggtagtgagtggttgggttgtgttgttaaattttttgtattaatttggtttgggatttaattaagtgatttttgatttttggaaagagtttgtttttagagtttatttagaagatggtttaattagatatttttttgagttgttaggttttagatgggtgggagttttgttttgtttaagttagtttaaggatgaggtttgtttggatttagtttggagttatgtgatgggtgtgagtgtgtgagtttttggtaaggtgtagaggttagatggagattttgtattttgtttgagaagtgttttattttttttaatatttggtttttttttgtatataaattaagttgaaaatagtttattatttattattttttatagttatggaattaaataatttagaaattaaaagttttattgtagttgtttttttttttattttttaaatggaatttaaaaagttttggtttgttaaaaggggaagattattttttgaattggaagtttgtagatatattgagtaatagttattttttttgggtttttgtaaatggtatttatttttttaatttatagttttagttgtttaattatttgagatttggggtaattatttgggggaatagtgtttagatggtagtgggagttattattttatagtggtttggggaagagaagagaaagagattagaggagggggtatttgttaaaattatttaatgaatatgttgttaatgtttttttatatttgtatgttattgttatagtttttttaggtgttattgagtttttagaaagtaattatttgttgaattaagtaaaataaggagaatggtatagtatatgtgtttggagaaggggaaggaagggtggaatatgaaattgagtatagatatttaggttaggaaagaaggaagtggtaaggggttaaatgaagttttatttttttgttatttttttaaataatagttggattaaatatttatttgtttttttttttttttttttttttttttttttagtttatgtttattttttttttttattttttttgtttttttttttttttgtttttttttttttagatatgttggtagttaatatttagtattagttgttatggtgattataaattatttaaatttaaaaatatttatttataatttgagatgaagtttttatttttttagtgaaataatattttaaaagttgttagttgataaaaaaaaaggaatttattttattgtagtaatttaagtaatatattatttttaaaggtttaaattaaaatgttagtttgttaaaaatatgttggtagagttttggatattttttttgttagatttttataaagaagttgattttgttatttttggttgttttttaatatatatatataattttgtatgttttttttttttttattaattttttttttttttattaattattttagtttttaaagattttatgtattgggttttaaaagaaaagaatttttttttggattagaaaatagttttattggttgttgaagtgaaagatgtggggtttagggggaaaggttattaggattataatggtggtggtggtaggaggttattttagaggagttaagaagaaaaaaaaatgtagggagaaggattggaggtggaaagatagagtaatagaaaattgagttgggtggttaggtgttgtggtgaagtttagttttgaaatgataggtatatatttttttatttttgttttttttttttttgagagaaaatttttttagttagagattttggggggtaggaggtgggtaaatgttgttgtagttgggttttttgttttttattttgggtttgttgttttttgtttattttggattatagggtatttgtttagatgaagagttattaattatttatttagttaatattaggaagatgataaagttttttatataggattaagaagatattagattgttttattagtatatttttgtttatgaataagtttttgttatatattttttttttttttgagttgttttaataattgttgtatatattagtagtgggtggtgaggaataatagttgaattagttttaagaaattttgtgtattgagttagtagtgaggaatgtgatttgtgaagattatttttgtgggtagggatttgtagggattgattatttttggataattggtataattttttttgggggtgaaaaattataatgtggtggggtattttttaagtgagttgtagatttgattggtgtggggggtgggggaggggaggggagaatgggatggtggaggttgggtggaggaaagaaaatggaaaattttttttatttttattttgttgttttttttttaagttttatgttttttttggtaagtatttgttttttttgtgttagttatagttagagttttttatttttttttatatatttttttttttttgataaggtttaggattttggttattattttatgtattattattttgtgttttgttagagatggtttgggttgattttgttggtgtttatgttaggattaaaatttttttatgatggtgaggaaaattgtattatttgtttttagggggtatattaggagtttatgtagtatatgttttgtaaatatttgttgattgaatgagaggtgtgggggtggggtggtggagaggggtttgtggttgttaaggttgttagggttaatttaggttttttgaagaaggttgggattgagttgttgttgtgtgtgaaggtgtgtgttgtggttgggggtgttataatgggttatggagtttattttttagagggaggaagtttgtgtatattagtgatttgggttgaatatttttagtttatttattgggttaaagttatttaataattaatgtgtttttgggggaggttgggggaagtatttgttttttgttgggatgtaaagttaggtgttaggtttaaaggggttgtagtgtagtttgattttagtatggaatttagagttgttgttttgaaattttttaagttagtgatagaggagggttagtttgttttttttttgagggtgaagattattttatgagttttttttaggatttttaaagtaagaaaagttaaagaaaggtttttttgttttagggggttgtttttagttggtttttatattattttttgttagttgtgtttatttttttttaaatttttggtttttaggggtttttagttgtttttgtgttatttttgttttggggttttatttaggttgggtatttgtttaatggatattaaggagaatgggatttattagggaaggaaggtagagtttggattgtttagaggtggattttgtttatatagaatgtttagtttttaatgaggatatggtatttttgggtggtgttgggggtagaggtggagagggtagtgtaatagattattatggttttttgaagaagttatatgttattgtgaattttttttttttttaaaagtaaagaaaaattttaaaaaaatataagaaataaatttttttgttttataagtaggttgtggttaggattttggatattttataagttaatttaaaattagggaaggataggtgttttattttttagtagtgttatagttttgtttatttgtgtgatttttttttgttgtttattagttttttaaaagttaattaaattaagatttttagtatttttttttattatatgtttttttttaattaatggtattaaatgtgtttaggtagtaatttttttttttggttaaaaagtagaaaaagatatattgagtgtaggggaagagttttttatgtgtattaaaataatgtgggtttgaaagtaatggttaagaaagtaattatttattatttttagttttttatgtgttagttattaaaagtgaatgattaggggtgtttgtgtggtttgtgattggtgtaagtagaatttttttgtttttagttgttttttgtttatttatgaggattttattttattgtaggtttttttatttgtttttagaatgtattttttatgtttaggaaatttggggtagggattgggggaaggagatattttgtgtttttttggtttttagtataataagaaatgttagttttggtttggtgattgtgagtttgttttgtgtgaagtgagattggggagtttttttagtttggttggagttagggttgagtttgtgtaaagtattttttttagaagttattgttgtttttgatttttaattatattttaaatatattatggtttaataatttatttttattattgattattaaatagaagaagaatttaatataatttaaatgatagaaattatgtgatgttatttttgtattgtttttatttaattttatggggttaattttggataagtgagtgtttaattggtttagtagggtgattggtggtgtagtgtagtgtttgggtgtgaagtattggattgttttagatgttttattttaataaatgattatttttttttagatttatggggaaattttaatgtaagatttttgttttttttttagtaatatggtttgtttttttgattggggttttaaattgtttttttttattttatattatatttgtatttttatattttaatttggaaagagggggttaggggttgagggttgtgggggggggggggttttatttgtttatattattaaaggttaatagttttttaaggttaggtatttatttattatggagttaggaaaatagaggaatagtaaatttgaggggtttttttttatgtatttgaaaagaaaggtatttttttttttttattttttatatttttttttttgttttatagaataagttttaatttaggaaaggtttgtggtgtaggttggagattttttaattttttatataagtttgtagattttttttggtaatgttttttgatttttttagagtgaaattagttaattaagtaatgatattgttaaaatttaaggtttggtaattagtattttaggtaggtttgtgttgataggggtaaatttttattttattttgggttgttaagtatagtggttgttttttagttttttagggatgttgttggttttttgttttttttttaattagttaaagtaaatttttgttaatttaagttttttttgtttgttttttgtgatgaattgtgtatttataagtttgggtggggtgtggttgagagtttgagtgattgagtgggttttggtggtgttgtgtgtagtgggatataatgagtgatagaggttgttgttggattatttttttatgttagtttagatgttgaggtttgttggagtgtgtgtaggggattagattatagggagtgagtgagagggagagagaggtgttgggttttaggagtgtagtataatttggggaaaggaattaatgtttttgggatggttgttttttgttttatttagaggtggagtgtttaagtttaagtagtaggtgtgttaggtttggtggttttgtttttttgtgttttgtttgaggtttagagttttggaggtgggtgtttagtgtgtggtttgtgttttttttttggttttattattggtgttaggatgttgttgtgggaagaatttgttgttggttgtttttttttggtttttaggagagtttgtgaatttgatttttttgattttggagtttttggagaagagatatttaatggttgttggttgtatgtttgggttatgtgtgtgtttgttttatgtgtggagagaggtgttttggattgtggttgaaaggagttggggatgggaggagggggaggggtgaggtaggttggaggagaaagagggataaagagtaaagatttagttagaggaaagagttgatggtatttttgttttttggattttttggtaatttggggtaggatggtgtattttttttgtgtttttttggttgttggtggttttagttgggaggagtaggttggggggttttggtatatagtgtgttgttgttttttagtttattgttttgttatagggagaggttattggtgatttggttttgattttttttttgtttaggttggttttttggggaagtgttttttgttggggttttgttgtagggttagtgtttttttgttgtttttatgtggtgtggttttttgtttgatgatttgggtaggagaagggggtttttatttaattgtatatatgttgatattagtttgtggtagttggtttttattttttgttatttgtaaaatagaagagaaggaaggttgtaagaagtggtggttgttgagtgagtagggtttagatgagattatgttatattagttgttaggtgtttattgtgtgttaggttttaggtgtgtttttttgatttgatagtttttggttgtgtagtagtatttttagtttagttttgggtttaggatatttatttattaagaggggatttttttttagagttgttgtaaaagtgtttagaggttagaggattataaagttatagtgtgttggggaggttgtggatttatttttaagaattttggtgttggggttaagaatttatttgaatgtaatggtagtgggagtgggtgggtggagaggatttttttttttgggaagttgtatgtaaagattattttttagtgtttgtttattagttggagtttggtaaatatttgtagaatattagtgttaatgtgtttttgttttagatagtagttttttttggttttttgtaattttgaaatgaatgggtttttggtttagggtgttttaggagtgagttgagtttgggttttttatttattaggagttatttttttatatttagttatatttttttttagagatattaatttggttatttatttatttattataaataattattttaaagtatgatttaagattgtagaggagagatattgggtggattgagtgagattgaggagagtagggtaaatgtttttggagggtttattgtttgttaaggatggagaaatagttttggtataattgttatttagtttttttttttttttttttgggtgagttaaattttttttatgtttttaattataatgtagtgagttaagtatttaatgtgtttttttttttttgttataggtaagttgggagaggtgggttttgaggggttttattgggtgggtagaagagttgtggttgttttaaagataagaaaagaaggtttagggttttttaggtttttttgattttagtgtttgtttttttttatgttaattagggtatgttgatgattggagggtttattttgtgtgggtgtggggattggggtgggagtaagtgttgttgggttggtggaggtatagaggtggggtagggagttgtgggtttgtttttggtttgagtattgtttttttgtgttttggttttttttgaagggagttgggttttggggagtttttggttaaggttgttgtttataggaggggttgtttggtgttgtggtgtggggatttagggtggggatggttaggtggtttttttatttgttagtgagaatgtgggtggggattttgttgatttgatttttgtgggtttgtgggtttagaagtagtagtttggtggttttagatttagtgattttgtagtaaaattataggattagtttttgattgagatgtttgtttgtgagatattataaaatttattattatagttttttattaatttgatatgaagtaatatagatgggattttattagtttagattttaaatgtttatttatgataattttggaggaaatttgtatgttattattattttgataattttttttttttatatgtttgaattggttgtattattagttggtagttggagtattgtagatggtaattgtaaatagtttttatttatttattttttttaaagaatgaaatatataaaagaaaaagattgtgttgtttggtgtaaagttagttaattattatatatttttttttttatttttttgtgttttagtgttgaagattaaataaagtaatataaaataaatttttaagaatttatagagttttattttaaggattgaaaagaaggttaaggtgtgttttttagtttatttttatatgtttttgtgatttggagatttattttgtagttaaaatgagttttgagatttgtatttttatgttttatttaatgattaggtttattagaagaattgagtttaaataattggggaagataattttttaaaaagagatttttaatttttgtttgttgatttttaaatttgttttattaagataagttttttgtgagaaatttggttgttagattttggaattggttttaatggttaattttataaattgagatgggagattttttttgatgggaggtagtttttatttttaaagtttatgttttagttggaatgtatatgttaaggatttttgttttggttaatttgggttttatattgtgagtatataaaaagtattatatggttaatggaggatgaggaattatggtaaagtaggtaggtaagttttaagaaataaaataatttgttaaaaaataatttttgatgattattgtaagattgaaagtgtaggaaaaatatagtttgaataattttagatttttttatattttttttttttttatatattttgttattttataataaaatttttaatggaaagtttaaaaataaatagtataggaatatgtgttttaaatgaattaaattgtgaaattagttagtaaattaatttgtagtaagtaattatttaaggaaattaaaatattgtttagtttagttttgtattttattatgtgtatgtgttttttataattaattaatataagtgttttaggaatatttgaagataaatatgtttaatttaaggaataaagtatttaaataatttaagtgtaattttgttgagttaaagtaaaatattttataaatgaagtggttatttaattttttagggaaagtttggttattgaaatgttgtatgtttatgttatattaataaaaatttttaatttattttgtttatgtgttttgtttttttgatattattggtatttgaattttagatggatttttgttaaaatgatattttgtgtgataaaagtatttttagttttgattgatagattaaaataaatgtaaggaaatttttttaaattagattaattttttataaaaatattttagaatgtatgaattttgatatttatatttataatggtaaaagttttttttgtttagtttagtaagataatatttatataaaagagtaaaaaaaaattatattattttatgatagtttgatttttaaattgtttaagaaagtaaagtggttaaattggaaaagaggaatatattttggaggtttagaattgaaaattttttttttaatttttagttggaaaataattttttgtatttatttaaagtgtattttttgaagtgttagattggagttgattggtgattaatttaaaggagttataatttaaagaaatggtgagagtttggtatttaggtttggtttttaggtaatttgtttgggtttgagaggttattaattgttagttaagatggaattttttttttttttttttttttttaatggataataatgggaagggggttaattttttagtagttgaaattttgtatttagttttttattttgagaatgttaatttttggtttgaggatttgtttttgtagtgttggtattgagatttaagggaagatattttgttttaaatgttagttatggtttggttttttttttgattttagtattttgtagattgttagtgtttgtggtgggggatgaaaggaatagggttttgtaaggtttgtttgttgattgtgttattttgggtgaaatttagttttaaaagttataaattatttatggtgaagattttttgaagtggaataaatttttagatttgtattattttatatttttgtgggatagatggtttttatttattggttattgggagagagttgttgtttttgtgttttattgttttttggggtgatttttagtgagttgagtttttggttgtatggtaagtgtttgaaagttgggtttgagaggattgtagggtttttgagggtgttaagttttgaaggagtttatgggtgtattggggtttttgaaatttagttgttattggtagtttttttttgtttttttttagtttttttgtttggttttgtattttttttttttttttttttttttattttttttttttttttttgtttttattttgtgtggggagtgatgtgatgttagtagagattttattaaattttattgtatagtggtgtgtgggtggttggttgagtttggttgtgtggttggtgatttaggagtgagtatagtgtttgggtgagtgttggggggagtgagtaggggtgatgagaaatgaggtaggggagggaagtagatgttagtgggttgaagagttgggagttggagttgggagagtgaaaggagaggggatttggtggggtatttaggagttaattgaggagtaggagtatggatttttattgtggaaaggaggattagaagggaggatgggatggaagagaagaaaaagtaatttgtgttaatttggtagttttaataaattaaagggggagtgttagggtagtggggagatagaaatgtatttttggggagtaaattaggatgggttgggaggaagtgatagggaaagtggtttaagagatggaataaaggataatgtttatggggttgtttgggatgaggtgtgtggagtgtgggtgtgagtgtgtgtgtgtgatttttttttaggtttgtagagttgaggaaagaggttatagtaaagagggattgtggagggaggaaagtgagagattggtagagggtgggagtggaggtgggtgtggtggggatgggagaggatgagtgaagagaaatttagaagaatggagtgagttagtgggagagggtgggagggttatagttgggagtgaatgagttaggtttgttagttggggaaggttgggatgttgggtttagtttagttgggatattgtgtttgaggttaaggtgggtggattaggtatgttgagagtgttggtgtataggtgggtatggttatgtattgatttagtgtttatgaagggtttgtattggataaggtttagatgtttatagagtttagaattttttttgttgtatttatatttaataagtttattttgggttatggatattttattttttaaaatgatgaggttaaggtttttggtgaggatggtattaaattgtatgggatagaagtgggggtgggggagagagttttttttaagtttatatttgtttttgtaaagtaaagagtatgtgaaattatagggtatatttttatttgaaaagtgtgttttatttttgaattttgattttttgattttttgatttgagtaaagatgtgtattttggtagtgagtagaatattttggttttgttttgtttttgagtggaaggattataaatataatttgtttggaggattaggtgtgaaggtttttgttaggtatatgggataatgtttttttaattttaagggtattttgttaatgtatgtttttggaaagtgttggaatatagttattgtttttggatttggatttttttattaatattaatttttgtttgagagtaaaatttaggtttgttattaaaaagatatttttttggtttttaattgagaataaagttttttttaaaagttgtattgttttttttaaattaatatattaatatttgtaattttagaaatatatagtgatttgggagaatgtgtataaaatagatatgtttaaaaaagtttggtgtttaaaattaattttagttattatataggtgttgggttttttttatttttgggggttgtttggaatatgttatgtgtttttttgaattattttgtgttttgaatttatttgagttagtagtaaaaataggtaaataaatttgtttaatttgttttgagtgttaaatttttttattttgaaatagttaatagttgatagatggatttattttatggaaagggttagtttttttagttatgaagaaaattgattagagatttatattttaagttatttttaatttttatgtaatatttgtgaaaatttaaattttttttttttatttagtggaaatttaaagtagtgttatttaaggggagagaaatgagggggaaaatgtttatgtgttgtttaattgtattttttttttgattttgagaatttttatttttggtttttgaaattttgttgaggtaagaaaattaaatttttttaataagttttataattgaattttagttataggatattggaaagtgtagtttgagaaagatatttttatttttgtttattgatgatttttgtagtttttttatttttttgagtaatgggttaataattttttttttttttttttttattttgtagagattaagaggtgtttgtagtagaatggttttgtttttagttggtggtgaggataggtaattttatggaaaagttggaagagaatgagaaaattaaagatagaaagatttagagatttgtggagagatatagggagagggaagggagttgtgttgaaaagatgtaaagatatgtgtgtgtaattttttttttttttaggttttagaggtttgtaaattagggttgagaggaaggggtttgggaagtttatgttttttttgttttttttttgtttggagttttgtttgttagaggttggttaattttagttttggttgttgtagatattgtgttgagtttttgggtttttgttttgtttagtgttagtgtagttgaagtgagtagttggtgggaaatgtaaatggtttttggagaaatagaagatatagaatgatttttattttttttttgagtgtgtggaaggagttggatatatgttttatgtttttaattttttttttatatttttagttatatttttattaaataattaattaatgtttagaattattagggaatatattaggtatgtaattgtagaagtagggtgttggggggttataaattattgagttgatttaagatgtggattttaggttttttttttgttaaagtagtaaaggaagagtgggttttggtgattgtatttagattttgattattttaaattagaagggggtggagggagtgtttaagtaaagtaagtaattttttgttttgtagatgtaaataagattgtagtattaaaggtattagtttttttagggttagattgtttggattgggagtttggggaaggggagatattaattttatgtatttgtgaattttaaggatgttatatttttatataaataattttagtgtggattttttggaatggggggagtaatatttttattttagaatattaaaatattttttttttaaagtgtatattttttttatttttttaaaattttgaattatgtttaaagataatagttttttagtaaattggagtattggattattttttttatttttttttattgatattttgatgatttgattttaatgtgtggggggtatagggaattaaatatagtttataaaattaagtttagatgaaatagtgttggttaagtgggtttagataatttttaatgagaattttaattatatttttttttttaatatgttgagataagtgatagaattgttagaatggtaattaaattggaaagtttagggagaataataattttgtgattaaattggggtaaaattgtggataaatgtggggtgatttttgttaattttttgttatttaagagttaggatttgggaaaggtatagtattattttagagtttgttgtgatgggttgtgtgttattatttattttttttattttggattatgattttaattttggtaagtaatttttttagttttttatttgataataagtgagtatgtaaatattaatggttagtgatgtttaattgttttaaatattattgatttgttggttgttttaaattgtttttttagtttaggttttgtttttgaattgtttattttagaggtttgatttatgtttttgatgttataatataataattgtttttttaaaaaaggtatttaagatgaattaattgatttgtatataaattaaaattattatgtgttgttgattttggtgttttataattattttgaaattagtatttaattatttgagttaaaagaatatataaatgtttgtattgatttattaatgaattatttaattaaaatgtttgggtaatgttgggtgttggaaagattgttaaattaagatatattataggagggatatgaagattagaaaggtaatagattaatattttgtatttaaaatggagtttttggtgatttttagttttaattttggagtaggggttttttttttttgttgttaaaaagattttgtgtttgtttgtgagtgagtgtatttaagtggaaggaatgtttttatggttatggtggtttaggttttttgtttggattgggattttatagttttaatttaggagtgttaaattttggaagattttgggttagttttggaggtgtgtggttttgtaagttgttaggttaagtttgttttttttgtttgtttttttggtaggttgggtgtgttatggtagtgagttttttgtgtaaatggagagttggaattaaagttgatatttaatagatatgttaattgagtatttatttttgttttgagaataggaataaaaggtagttttttttaagagaggtggtgtaaaggtatgttataggagtttagaaaaggttggtggtgggaaatttgtagtttgggggttagttaatatttttttttattttaagtatttattgatttgttgttgttatttttggtgatgtagaaggatatttgaaagaatttttgatggggttttgatttgagaaaggaggtgatttgtttaggtttttattaaatttttaattattatattaattgtttttttttattttttatttgatttttttttttttgtttatttttaattttttaattatttagaaatttttttattttttagtggttttttttttgtagtagttttttatttgaattttttttttgtttttttgtggtagggtttgtatattgatttttttgatttttggtatatttgggttttttgaaattttttaatttttttagatttgaggatggtaggttttattttttttattgtgtgtatatatttagagatatgaaaatttatatagattgtttttaaatttagggtatttaatagatgttttttttttagtttgttttttgatttgaaatgtttgtttgattttaatttggatattatttttttttgtttttttttttttaaagtagtttggatatgtgtgtaagtgagtttagaatagttttatttatattttttattaaattgtaaataaaagaagaattaatgaagtagattggtatatagattgtattaagagtttgaatttttagtttttggattttttatttaattttggttgttatttatattgatagagttattttaagtagaggtttagagaaatttgtattgtgggataataggtaaagttatagtaaaaagtggaataattttaaagttattttattagaatgtaaattgtatttttgggttttgtttgtaattatttagttttaatatatatagagttagataggaaaaaataggttaatatagttattggtattagagaagataaattttatgggttttttagtgaaaagaagatttttaaagtttataatttttgattatttaattttatttataattgtgggaatgaataagatattaattgttttatgtattttatttatattaattaatttgtgtttttattaaaagtagttatatagaattttttttaatttttggtagtaagtttagaaaatgaagtttatagttattttgaattggatatattttttgagttgattatttttgtaagtgtaggaatataatattgtttttttatggtttttttgtatttttttagggtttgtaagtttttattaggtttgatattattgtttgggtttatatttattataagtaaatttgattattatgttgattttaaaatagtttatttggttagtataattttagtttttaaattataaaaattttttaatatatgaagtttttagtttttattttttttagttttttgtttatttaaaatttttattttaattggtgtaagtaataataatttgtattattatttgtattttttttatttttttggagattgggttggattttagagagaatattagtattattattattataaataataaaatttaaaagtaaagtttttatttgtatgataattggtatttggaatgtttttgatttatttaatgttattttataaaggtattttgtaaatttttttggaatttttagtaagagtttgtagtaattggaataattttttgggaagatattttttttgatgggtttttagtttttggaggaatagattgagagtaattagggagggaggggatattggaaattggtagttatgttagttgaaataagtttgggtttagtaaggtgattgatgttgtggttgattttttattttgagtttttttttaattggggtattgattttttttattttgggattttaaggtatttggtgtgtatgtagattttttttttgtggtttttattatgtggttttgtagtaggtttttggtttaatgatattttatagttatagtttttatatttattattatgattttaatgtttaggtttttagtgtatttatattaaatttgttttattagtaagttggagtatataggagagatgggggtaagtaaggatttagtagagtttaaatttagatatgtttaaatggttttgattgtgtaaagtgtggtaatgttttttgttgttttagttttttattttaagttttatatgttttttggttaatgaagtgtgatataggttatatgttaggaataatagtatttgttgagaataaagtgaatttaggaaatttggtatatataaaatgtatt

SEQ ID NO: 1137 - DNA, 28536 bp, Artificial Sequence
  chemically treated genomic DNA (Homo sapiens)
gatgtattttgtgtatattaggttttttgagtttattttgtttttaataaatattattatttttagtatgtggtttatattatattttattagttagaggatatgtgaagtttagagtggaaagttagggtagtaggaagtattgttatattttatatagttaaagttatttaaatatgtttgaatttgagttttgttgagtttttatttgtttttattttttttgtgtgttttagtttattaataaagtaggtttaatataaatatattaaaagtttaaatattgagattatgataatgaatatgagggttatgattataaaatattattgaattagagatttgttatgaaattatatggtgaagattataagggaggaatttgtatatatattgagtgttttgggattttaaagtgggaagagttagtgttttaattaaagagaaatttggggtagggaattaattataatattagttattttattgaatttaggtttgttttagttgatgtagttgttaatttttaatgttttttttttttttaattgtttttaatttatttttttagaaattgaaagtttattaaagaggatatttttttagagagttgttttagttattataagtttttgttagaaattttaagaaagtttataaggtatttttataaggtggtattgagtaagttagaagtattttaagtattaattattatgtaaataagggttttatttttagattttgttgtttgtggtggtggtgatgttggtgttttttttggaatttagtttaatttttaaaaaagtaaaaggagtataaatagtaatataaattattattatttatattaattaaaatagaagttttgaatgagtaaggagttagaggaggtaaaaattgggaattttgtatattaaaaggtttttataatttgaaaattaagattatgttggttaaataggttgttttaaaattagtatagtaattaaatttgtttgtaatgaatgtagatttaaatagtgatgttagatttgataaggatttgtaaattttaaaagagtgtaaaaagattatagaagaataatattatatttttgtatttatagaaatggttagtttaagagatgtatttagtttagggtggttgtaagttttattttttgaatttgttattagaagttaaaagaaattttgtataattgtttttgatggaaatataaattggttgatgtaaatgaaatatataaagtagttggtgttttatttatttttataattataaatgaaattaaatgattaaaaattatagattttggggattttttttttattgaggagtttatggaatttgttttttttagtattaataattgtgttgatttatttttttttgtttaattttgtatatattaaaattaggtggttatgaataaaatttagaaatataatttatattttaataaaatgattttaaaattattttattttttattgtggttttatttgttgttttataatgtaggtttttttgggtttttgtttagaatgattttgttaatgtagatgatagttagagttgaatggggaatttagaaattggggatttgggtttttgatgtaatttatatgttaatttattttattagttttttttttatttatagtttggtaaagaatatgggtggagttgttttgggtttatttgtatatatgtttaaattgttttgaaaaaggaagggtaagaaagagtggtatttaagttggaattaggtaggtattttagattaagagatgaattggaaagggaatatttgttagatattttgggtttgaaggtagtttgtgtaagtttttatatttttgagtgtgtgtatatagtggagagggtggagtttgttatttttaaatttgaaaagattgagagattttagagggtttagatgtgttaaaggttagagggattaatatataggttttattatggaaaggtggggaaaaggtttgaatagaaaattgttgtagaagggaagttattgagaggtaagggagtttttgaataattaaaaagttaagaataagtaaaaggaaggaggttgggtgggggataaaaaaaagtagttgatgtggtaattaagaatttggtgggagtttgggtaggttatttttttttttagattagagttttattagaaatttttttaagtgtttttttgtgttgttaaagatgataatagtaaattaataagtgtttgaaatgaaaggggatgttgattagtttttaggttatagattttttgttgttagttttttttgaatttttatagtgtgtttttgtattgttttttttaagaagagttattttttatttttatttttaggatgaaggtaagtgtttagttagtatatttattaaatgttagttttggttttagttttttgtttgtgtggaaagtttattgttatagtgtgtttagtttgttggaggggtagatagaaaaagtaagtttggtttggtgatttgtggggttatgtatttttagggttggtttggagttttttagagtttaatgtttttgggttagaattgtaaggttttggtttgagtaaagggtttgagttattgtagttgtgggagtgttttttttatttgaatgtatttatttataaataagtataaaatttttttaatagtagaggagaaagatttttgttttaaaattaaagttgggaattattggaaattttgttttgagtgtgagatattggtttgttatttttttaatttttatattttttttgtaatatgttttgatttaataatttttttagtgtttagtattgtttggatgttttaattgggtaatttattagtgagttaatataggtatttatatatttttttagtttaagtggttaagtattaattttgaaatgattataaaatattggaattggtaatgtatagtaattttaatttatatgtaaattaattggtttattttaaatgttttttttaaaaaaataattattgtattgtagtattggaggtatggattaaatttttagaatagataatttggaaataagatttggattaggaagataatttagaatagttaataaattaataatgtttgaggtagttaaatattgttagttattggtatttatatatttgtttgttgttagataaggagttggggaaattgtttgttagggttgagattataatttagagtgaagaaagtaaatggtagtatatagtttgttatagtgggttttgaaataatattgtattttttttaaattttgatttttgggtgatagggagttggtggaggttattttatatttgtttatggttttgttttaatttgattatgaaattgttgttttttttgagttttttaatttgattattattttaatggttttgttatttgttttaatatattggggggaggagtgtaattgagatttttattaaaaattatttgaatttatttagttagtattgttttatttaagtttagttttatgggttgtatttaattttttgtgttttttatatattaaaattagattattaaaatgttggtaggaaagggtgaaggaaatggtttaatgttttagtttattggaagattattatttttagatatagtttaaaattttgaggaaataaaaaggatatatgttttggggggaaaatgttttaatattttagaatgggggtattattttttttattttagagaatttgtattggagttgtttatgtaaaaatgtaatatttttgaaatttatagatatgtaaggttagtgtttttttttttttaggtttttagtttaggtgatttagttttaaaggagttagtatttttgatgttataattttgtttatatttgtagggtagagaattgtttgttttgtttggatgttttttttatttttttttaatttgaagtaattggaatttaaatatagttgttaaggtttgttttttttttattgttttgataagggaaaaatttgaaatttatgttttaaattagtttggtggtttgtagttttttagtattttgtttttatgattgtatgtttaatgtattttttggtgattttgggtattaattagttgtttaataggagtatgattaaaaatgtaaaagaaggattaggagtgtgaaatgtatgtttagttttttttatatatttgaggagggaatgagaattattttgtattttttatttttttaggagttatttgtattttttattagttgtttattttagttgtattggtgttgggtaaggtgaggatttaaaagtttagtgtagtgtttgtggtggttgggattggggttaattagtttttggtgggtgagattttagatagaaggggggtgagaggaatgtgagttttttgagttttttttttttagttttggtttgtaaatttttgaaatttgaaaggggagggagttgtatgtgtgtatttttgtgtttttttagtgtaatttttttttttttttttgtgtttttttgtggatttttgaatttttttgtttttggtttttttatttttttttaatttttttatgagattgtttatttttgttattagttgaaggtaaggttgttttgttatgagtgttttttaatttttataaaatgaaaagaaaaaaagggaggattattagtttattatttagaggaatggggaggttgtaaaaattgttgatgggtagaggtgaagatgttttttttggattgtattttttggtgttttgtaattagagtttagttgtgggatttgttgaagaaatttgatttttttgttttggtgagattttaaaaattagaaatagaaatttttagagttagagaggaaatataattaaatagtatgtgggtatttttttttttatttttttttttttaaataatattgttttgagtttttattgggtaaagagagaaagtttgagtttttatggatgttatgtggaggttagaaatggtttaaaatgtagatttttaattagttttttttgtggttgaagaggttaattttttttataaaatgagtttatttgttgattgttagttattttaaagtgaagggatttagtatttaaaataaattgagtaagtttgtttgtttgtttttattgttaatttaaatgaatttaaaatatggagtaatttaagaaaatatataatatgttttagatagtttttaaaagtagggaaagtttagtatttatatagtgattagggttagttttaagtgttaagtttttttaaatgtatttattttatgtatatttttttgagttattatatatttttaaaattgtgagtattggtatattgatttaggaagagtaatataatttttagagggaattttatttttaattagggattaaagagatgtttttttaatagtgggtttgagttttgtttttaagtaggaattaatattggtgggaaaatttgaatttaggagtaatggttgtgttttggtattttttaaaaatatatattaataggatgtttttgagattgaaaaaatattgttttatatgtttggtagaagtttttatatttggttttttaggtgaattatatttatagtttttttatttagaggtaggatagagttaaaatattttgtttattattaaaatatatatttttgtttaagttaagaaattagaaaattagggtttagaagtaaggtatattttttgagtgagaatatgttttgtaattttatatattttttgttttgtaggagtaaatgtggatttgagggaaatttttttttttatttttatttttattttgtgtaatttaatattatttttgttaggaattttaattttgttattttaaaaaatgagatatttgtgatttagggtgaatttgttgaatgtaggtatagtagaggaaattttagattttatgagtgtttgagttttgtttagtgtaaattttttgtgaatattgggttagtgtgtggttgtgtttatttgtgtgttgatatttttagtatgtttggtttatttgttttgattttgggtgtggtgttttagttaagttgggtttagtgttttggttttttttagttgataagtttagtttgtttgtttttggttgtggtttttttatttttttttattagtttattttatttttttagatttttttttatttatttttttttatttttattgtgtttatttttatttttgttttttattggttttttatttttttttttttgtagtttttttttgttgtgatttttttttttaattttgtaggtttgaaagaaggttatatatgtatgtttatatttatattttatatgttttgttttaaataattttatgaatattgttttttgttttgttttttgggttattttttttgttgtttttttttagtttgttttgatttgttttttaaaagtatgtttttgtttttttgttgttttggtgttttttttttgatttattagggttgttgggttggtgtagattgttttttttttttttttattttatttttttttttggtttttttttttatagtgggagtttgtgtttttgttttttggttggtttttaagtgttttgttaggttttttttttttttgtttttttggttttggtttttgattttttggtttgttggtatttgttttttttttttgttttgttttttgttgtttttgtttgttttttttggtgtttgtttgggtgttgtgtttgtttttggattgttagttgtgtagttgggtttggttggttgtttgtgtgttattgtgtagtggagtttggtggaatttttgttgatgttatgttattttttatatggagtaggagtagagggaagagagagggatgagagggagggagaggagagagagtgtgagattgagtgagaaagttggagaggagtagaaagaaattgttagtggtggttagattttggaggttttagtgtatttgtggatttttttggaatttggtatttttaggagttttgtagtttttttaggtttggtttttgggtgtttgttgtgtagttggaggtttggtttgttggaaattgttttgggaagtagtgggatgtggagatagtagtttttttttggtagttggtaagtggaggttatttattttgtagggatgtgagataatgtgagtttggaaatttgttttattttggagaatttttattgtaggtgatttgtggtttttggggttaagttttgtttaaggtaatgtagttggtaaatagattttgtaaagttttgttttttttgttttttgttatagatattaataatttatagggtgttgaagttgagagggaagttagattgtggttggtatttaaaatgaggtatttttttttaaattttggtgttaatattgtaggaataaatttttgggttaaggattagtatttttaagataaagggttgggtataaagttttagttattggaagattagttttttttttattgttatttattgggaaaaaaaagaaaagaaaaagattttattttaattggtagttagtgattttttaggtttaagtgaattatttgggagttaggtttggatgttaagtttttattatttttttggattgtaatttttttaaattgattattagttaattttaatttggtattttaggagatatattttaaatggatgtagagaattattttttagttggagattaagaaaaaaatttttgattttaaatttttgaaatatgttttttttttttagtttaattattttatttttttaagtaatttagaaattaaattattataaggtggtgtgatttttttttatttttttgtgtgagtattgttttattaaattaaatggaaaaaatttttattattataaatgtaaatattagaatttatatattttaaaatatttttatgaaaaattaatttgatttaaagaaatttttttgtatttgttttagtttattaattaaaattaaagatgtttttattatataaaatattattttggtagaaatttatttaaaatttaaatattaataatattaagaaaataaagtatataagtaaaataaattgaagatttttgttgatgtaatatgagtatataatattttaataattaaattttttttaaaaaattaaatagttattttatttgtggaatgttttattttaatttagtaaaattatatttaaattatttaggtgttttgttttttaagttaagtgtgtttgtttttaaatgtttttaaagtatttatattaattggttgtaaagaatgtatatatatggtaaaatatagaattgaattgagtagtattttaatttttttaaataattatttattataaattaatttattggttaattttataatttagtttatttaaaatatatgtttttgtgttgtttatttttaaattttttattaaagattttgttatggggtaataaagtgtatgaaaaggggggaaatgtgaaaggatttgggattatttgaattgtattttttttgtatttttagttttgtggtagttattagaaattattttttagtaaattgttttattttttagggtttgtttgtttgttttgttatggttttttgttttttgttagttgtgtagtgttttttgtgtgtttataatataaaatttaagttggttaaaataagagtttttggtatatatattttaattagaatatgaattttgggggtgagaattattttttattaggaaaagttttttattttaatttgtgagattagttattgaagttagttttgaagtttggtagttaaattttttatagaagatttgttttgatagggtaagtttaaggattagtaggtgggaattggaggtttttttttaaaaaattattttttttagttatttagatttagtttttttagtaggtttggttattaaatgaagtataaaaatgtaagttttaaggtttattttgattgtaaaataaatttttaagttataaggatatgtaggagtgagttaaggaatatgttttgattttttttttagtttttagagtggagttttatgagtttttgaagatttgttttgtattgttttgtttggtttttagtattgaagtatggggaagtggggggaagaatgtgtaataattgattgattttatattaagtaatgtaattttttttttttgtatattttattttttaaaaaaaataaataaataaaaattatttgtagttattatttgtagtgttttggttattagttaataatgtagttagtttagatatataaaaaaaaaagattattgaaatgatgatgatatgtaaattttttttgaaattattataagtaaatatttgaagtttggattaataaaattttatttgtgttattttatattgagttagtagaaagttgtgataatgaattttgtaatattttatgaatagatattttaattagggattaattttgtgattttattgtagaattattaaatttggagttgttaaattgttatttttgggtttatgggtttataaggattgaattggtagagtttttgtttgtgtttttgttagtgggtgggggaattgtttggttgtttttattttggatttttatgttatagtgttgggtagttttttttgtaggtagtgattttggttagaggttttttagggtttagttttttttaggagaggttgagatgtagggaaatggtatttaggttagaggtaggtttgtagttttttgttttgtttttgtgtttttgttaatttgataatgtttgtttttattttgatttttgtatttgtgtgaagtgggttttttggttgttggtgtattttggttagtgtggagagaggtaggtgttgagattgaaggggtttagggagttttggattttttttttttgtttttaaagtaattgtggtttttttatttatttggtggagttttttgagatttattttttttggtttgtttgtggtagagaagggggagtgtgttaaatgtttggtttgttgtgttgtggttgaaaatgtgaaaaagatttggtttgtttgggagagaaagggggagaattgggtagtagttatattagagttatttttttgtttttggtgggtagtaaattttttaagaatgtttgttttgttttttttagttttgtttagtttatttagtgttttttttttgtgattttaaattatattttagggtaattatttgtagtaagtaaataaatggttgggttagtatttttaggagaaagtgtggttaaatatggaaaagtggtttttgatggatgagaggtttgaatttagtttgtttttgaaatattttaggttaagagtttgtttgttttagaattatagaaaattgagggaaattgttgtttaggataggggtatgttggtgttgatgttttataaatgtttattgagttttaattaatggataagtattgaagggtggtttttgtatatagttttttaaagagaaaagttttttttatttatttatttttgttgttattgtgtttagatgagtttttaattttggtattgagatttttgaaagtaggtttatagtttttttagtatattgtggttttatagttttttaatttttgggtatttttgtggtaattttggagggagatttttttttgataaataaatgttttgggtttgaggttaggttggagatgttgttgtatagttagaggttgttaggttggaaaaatatgtttgaagtttagtatatagtaggtgtttaatagttagtgtaatgtagttttatttgagttttgtttatttgatggttgttgttttttatagtttttttttttttttgttttgtagataatggggaatggagattaattgttgtaaattggtgttggtgtgtgtgtaattaggtaagaattttttttttttgtttgggttattggatgggaggttgtgttatgtgagggtggtaagagggtattggttttgtggtgaggttttagtgaggggtgtttttttgaggggttagtttgggtaggaaggaaattagaattaaattgttagtggtttttttttgtggtggggtggtggattaggaagtagtggtgtgttgtgtattgaagttttttagtttattttttttggttggaattgttggtaattggggaggtgtagaaagagtatgttattttgttttgggttgttagagggtttgggggatggggatgttgttagtttttttttttaattgggtttttgttttttgttttttttttttttttggtttgttttgtttttttttttttttttgtttttggttttttttggttgtggtttgggatgtttttttttgtatgtggggtgggtgtgtgtgtggtttaggtgtgtagttggtggttgttgaatgttttttttttaaagattttgaaattaaaaaggttgagtttatggatttttttgagagttgaaaagaggtagttagtagtaagttttttttgtggtagtattttggtgttaatggtaaggttgggagggaagtgtaggttgtgtgttgggtatttgtttttgggattttgggttttgggtgaagtgtaagaaggtgaggttgttagatttgatgtgtttgttgtttgaatttagatattttgtttttgggtgggatgggaagtagttgttttagggatgttaatttttttttttaaattatattgtatttttgagatttaatattttttttttttttttgtttgttttttgtggtttgattttttgtgtatgttttagtaaattttggtgtttaggttggtgtggaaaagtggtttaatagtgatttttgttgtttgttatattttgttgtgtgtagtattattagggtttatttagttatttaggtttttagttatgttttatttagatttgtgggtgtgtggtttattgtgggaggtaagtaagggaaatttgagttggtgaaggtttgttttggttggttgggggaggggtggggggttgataatatttttgaagagttggagggtagttattgtgtttagtagtttagggtagaatggaggtttgtttttgttgatgtgaatttgtttgaagtattggttgttaggttttgggttttggtgatgttgttgtttgattggttggttttattttggaggaattgagggatattgttagaggaggtttataggtttatgtaaaaagttaaaaagtttttaatttatgttataggttttttttgaattgaaatttgttttatggggtggaggggggggtgtaagggatggaggagggaagatgtttttttttttaaatatatggaaaaaaattttttaaatttattgtttttttatttttttggttttgtagtaaataagtgtttagttttaggaggttattgatttttgataatgtgagtagataaagtttttttttttttatagtttttggtttttaattttttttttttggattaaagtgtaagaatataaatgtaatatgggatggaggggggtgatttgggattttggttaaaaaaataaattgtattattaagaagaaaataaaggttttgtattggagtttttttgtgaatttgagagaaaatgattatttgttgaaatgaagtgtttaaagtgatttagtgttttatgtttggatattgtattatattgttagttgttttgttgggttagttaaatgtttatttgtttgggattaattttatggggttaaatgggggtaatgtagagataatgttgtgtgatttttgttatttagattgtgttaaattttttttttgtttgataattggtagtaaaaataaattattagattgtagtatgtttgggatatggttaaaaattaagagtagtgatgatttttggggagaatgttttgtgtgggtttagttttggttttggttagattagaggagttttttaattttgttttgtgtggggtgggtttgtagttgttaagttgaggttgatattttttattgtgttgggagttagagagatgtaaaatgttttttttttttagtttttattttaggttttttagatatggggaatgtattttgaggataggtggagaagtttatggtaggatggggtttttgtaggtgagtaggaaatggttaagagtagaggagttttgtttgtgttagttataagttgtgtaggtgtttttggttgtttgtttttgataattagtatataaagaattagaaataatgaatgattgtttttttaattattatttttaggtttgtattgttttagtgtatgtgaaaggttttttttttatatttaatatgtttttttttattttttgattgaaaagaaaaattgttgtttaaatatgtttaatgttattaattaagaaaaggtatgtaatgggaagaaatgttgaaaattttgatttaattggtttttaaggaattagtagatgataaaaaaaaattatatgagtgggtaaagttatagtattgttgaaggatagagtatttatttttttttgattttaagttaatttatggaatatttaaagttttggttatagtttgtttgtaaaataaaaggatttattttttgtgtttttttaaagtttttttttgtttttaaagagaaaaaaagtttataatgatatatgatttttttaaaaggttgtgatagtttattatgttattttttttgtttttgtttttaatgttgtttaaaaatattatgtttttgttaaagattaaatgttttgtataggtagagtttatttttaagtagtttaggttttgttttttttttttagtgagttttattttttttggtatttattgggtggatgtttagtttggatagaattttgaaatgggggtagtatgagagtgattggagatttttaaaagttagaggtttgagagagggtggatgtagttagtagaagatggtgtagaagttagttgagaatgattttttagagtaaagagatttttttttggttttttttgttttgggggttttgaaaggaatttataaaatggtttttatttttaggaggaggatggattgatttttttttgttattggtttaaaaagttttagggtggtggttttgggttttgtgttgaaattggattgtattgtagtttttttggatttgatgtttggttttgtgttttgataaggggtgggtattttttttggttttttttaggaatgtattaattgttaaatagttttggtttagtggatgggttgaaagtgtttgatttaagttgttggtgtgtatagattttttttttttgggaggtgggttttatggtttgttgtggtatttttagttgtgatatatatttttatatgtggtagtagtttggttttaattttttttgaaggatttgggttaattttggtggttttggtggttgtagatttttttttgttgttttgtttttgtgttttttatttaattagtgaatgtttgtggagtatatattatgtggatttttaatgtattttttgaaagtaaataatatagttttttttgttgttatgaagggattttaattttaatatggatattagtgagattagtttagattgtttttagtaaaatgtaaaatggtggtgtgtggggtggtgattaaggttttgagttttgttagaaagaaggggatgtgtagagaaaggtggagaattttagttgtggttagtgtggaagggataggtgtttgttgaagggggtatgaggtttgaggaaaaagtaatgaaataggggtaaggagagttttttatttttttttttttgtttgatttttgttattttatttttttttttttttttttattttttgtgttaattaaatttgtagtttatttgaaaggtgttttgttgtgttgtggttttttatttttaggggaaattgtattagttgtttgaaagtagttagtttttgtggatttttgtttgtaaaagtggtttttataggttgtgttttttgttgttgatttggtatataaagttttttaaggttggtttggttgttattttttattgtttgttgttaatatatgtagtagttgttagagtggtttgggggaaaaggaaatgtataatgaaagtttatttgtgagtaggaatatattaatggaataatttgatgtttttttaattttatgtaaaaagttttgttgtttttttaatattgattgaatgggtaattaatggttttttatttaggtgaatattttgtaatttaagataggtaaaagataataagtttaaggtagaagataaaaggtttaattgtagtggtgtttgtttgttttttattttttagggtttttgattaggaaagtttttttttagaggagaaaaaggtaggagtgggagaatatatatttattattttggggttagattttattgtagtatttgattatttagtttagttttttgttattttgtttttttatttttagtttttttttttgtatttttttttttttttaatttttttaggatgattttttattattattgttattatggttttaataatttttttttttaaattttatattttttattttagtaattaatgaggttgttttttgatttaggaggagattttttttttttagaatttaatgtgtagagtttttgagaattaaagtagttggtaggggaggaagaaattaatagaaagggagagagtatatagaattgtgtgtgtatgttaaagagtgattaggaatgatagagttaatttttttgtgaggatttgatgggaagagtgtttaagattttattagtatgtttttaataggttgatattttaatttaaatttttagaagtaatatattatttgggttattataatgaggtgggtttttttttttttgttagttgatagtttttaaaatattattttgttagggaaataaaagttttattttagattataggtgggtatttttggatttaggtgatttatggttattatgataattaatgttgaatgttagttattagtatgtttgggagagagaaaatagaaagaagggagagtaaaagaaatagaaaagggagatggatataagttggagagggaagaaaagagaaaaagaggaagatagatgagtgtttaatttaattgttgtttaaaaaagtggtgggggggtgggattttatttagttttttgttattttttttttttttgatttggatatttatgtttaattttatattttatttttttttttttttttttaaatatatgtgttatattattttttttattttatttagtttggtaagtagttgttttttggagatttagtgatatttaggaaaattgtggtagtaatatgtaaatgtgaggaagtattaatagtatgtttgttgagtgattttagtaaatgtttttttttttaatttttttttttttttttttttaggttattgtgaggtggtaatttttattgttatttgaatattgtttttttaggtagttattttaaattttaaatggttgagtagttagagttgtgggttggaaaaatgggtattatttgtagggatttagagagggtggttgttgtttaatatatttatagatttttaatttagaaaataattttttttttttgataagttagagttttttaaattttatttaggaaatggggaaaaggatagttatagtgaagtttttaatttttgggttatttggttttatagttatgaggggtggtgggtagtggattgtttttagtttggtttgtatgtagagaaaagttagatattggagggggtggggtattttttgggtaggatgtaaggtttttatttgatttttgtgttttattaggagtttatatatttatgtttattatgtggttttaagttgagtttaggtgggttttgtttttgagttagtttgggtagggtaggatttttatttgtttaaggtttaatagtttagggagatgtttaattaagttattttttgggtgaattttgaagatagattttttttaaaagttagagattatttggttgagttttaggttagattgatatggagagtttggtggtatagtttaattgtttattgttatggttagagggattttgtataattaatattgaagagtgtgaaattaaataagattttaagattggtaattggtggtaaatattagtataaaatatggttgattttatgttatatattttttttttttagggtttttttttgaaagaataagtaagaaattttaattgagataatttttgatgttttttagatttaaaattttatgttggtattgggttttttttttttgttttatgtgagttatgtagtatttttagtttttttattaggattttattaatgttttttgtattggaaatttttgtgttagaggttgaatttatagtaatttttaaaattaattaagaagaatttagttagaggttatagtaatgttggaattataaaatgtataagatttatttttttttggttttttttttatttatgttgtttatgtttgtgtatttataagttttatgtatattaaatttttaaaattaattattattatgttatagagtttttattggatagtgttttttagtttttattatatatttttttttttttatgtagatttattatgttggtgttttgttatatagggggtttgagaagaatgttatttaattgttgttgttgtgagtgtgtaaagtgattaggagattaggagaatgttgaaatttttgttggaaaaatgtaaagaaaatttttattttgagttagttgtttatagagttagtgtgtgtgtgtgtgtgtgtgtttgtaatataaaatggatgtgaatatatatatataaatagatatggttttgtttttattttaatttgaattatttagataattgtttttatttattatttgattttaatgggtttatataaattaggatattttatttttttaggtatttaggttgttgttgatttttagtgtttttaatattttgtatatgttggtattatgaggagtagttatgtgtttttgggttttttaattattttggaggttgattgaggttttttatatatgtatatttgttgtgatgaaagttttattggtagagtggagttattagagtttttattaaaattttgtgggtttatgagagatgggtttagaaatttatatggttttgtggggttttttggttttttaaaataaggtattaatatttaagtttttaaaaatatttgtagttttggggtttgaattttgaaaaataaggagtgaggggttgtgtatattaattatagtggagattttttttattttttaatgtgatggagtttttttatgaaatgaagttttaaggggtatggtattgtggggattatagttattttgaggtttaaaagaagaaattggaatatgattagtaaatatatttagtagaaaagagttggatttttattgatttagttataggttattggttggtagtgtaatgggaggaaatatttattttatatatatattttatgattttgggggaattagaggaaatttaataagaaaatggttagaaatatttaaaatttttatttaaaagatttaagtaaattagagttttattagattaaaaattattataaatgtaagagtattgtttttagtgaaatgttgtggggtttgagaaggagattttttgttaaatttttgggataaaatgtgttatttaagtattagataatgagtagaatgtaaattaatttaattttttttattaataggttgttagtgtaatgtgtataatttagtgataagattgtaggatttaatatagttggatgtatgagttttagttaatgtagatttgttatatgaggatgtgttttattttgagtaggtgtttgtatgtgtggaatggggtaaagtggaataaaaggttaaaagtagaaatgttgatttaaagtttattatgaagaaattttttttttgtagttaaattatttttaaagtgggatgatattggtgaagaaagattgaaaaataatttttatgtgtgtttttggattgtaagtttaaaatggggaggagttgtagatagggtttgggggtggttagggtaaaggagagatatataagttgtaaatatatttgtagtttgttttatttattttgttttatattgaataagttttttaattttgtgaataaggataaggagggagtgttttaaagatattttatgttggtattgtaaattattgattgtaatgttaaataaatatatatttagagatgataatattaattttatagtaaaataattgtttatgtagaaatttagaggagattagtttgttttttttagttgatttatgttgggggataaaaggatttttaaaaattattttgaatatgtttggatttttttttttaatttttttggaaattaaatttgtttggaaatagtgttataaagagttgatgtttttaaaggtgattttttttgttttatataaataaggttttgtttttgttagttgagtgtagttttaggttttttgtttttagtttatatatattttttttgtttgtttggattttaatggtttaagatagttttgagtttattgggaaaagaaaatgattgttaaaaattatttttgaaattggttatttggtaatatttttaattgtatggaaatttattaaggtatattttatatataattagtttaaggttgttgattttataggttttatggatttaaatttgattgataataaagtaaataagagagttgaatttaaagtgtggtttttttgggttaggatgagtttaatatagtgtataaggaatttgaaagatttaggatatgtgttttaattaatgttaagtagaatggataagtttttagtattttgaaaatgttgggttagggttttttttttattgtgtgttttttgtttggggattaataagtattatagagaatgtgatttgaggtgattttttatttttgtataaatttagagtgaattattaaatagttgtttgtttaaagttaaggtaatttttttttgatgggtttatttgttttttgatttttaatttattagtttgtttttttagggttttgttttttttgtaattaaagtttttttagattagtgtagtatttatttgataggttgtttggaaaatttaagattggagaggtgatttgttgttgttttttaaattttttagttttaagtaatgtgttttttttttatatggggtgggggattggaaatggatgtagtgagatataaagagtgggtgttttgttgatttttgtatttttttttttttgattattttattttttttttttaagtttttgatttttagttttatttttttatttttgggtttgtattaaaagttggattgttttgggttgggtaggagttgaatttttgggagtttgtttgtgtagatttagtgtgtatggtgaggtagtagtttggttttgtattgttgataggtgtaggtaggatagtttttttattgtggtttggggtgttttgattggtgtggagttatgttagttgtatttggagaagggtttgggaggaggtggaggtggagagggttggggagggttgtggtggagtgatgttttggtattaggaagtttgtttttggttttaagatgttaggttaatagggaagtgtggagttgtagatttggtttgttgtttgtttgggtgtttggagttgagttgtggtaaggtttggtttttgtttgattgtttgaggggtgtgtgtgtgtgtgttgtggagggtgtgtttagagggttgtgttgtggttgtagtggttgttgttgttgtaggggatttaatattatttatttgtttttgttatttttgatatttttttgttagggttgttgtgtggggggggggtgggtagagtgtggttggtgttagttttttttattggaggggtttttgggggagggagggagagaagaagggggtttttgtttatttttgttttgttttggagtttggaagtttgttttttaaagatgttttgagtggtgtttttttgtttatattttatgtttttgtttgtttgttgattttttgtttttggatttttttgtttgagttttttggaggagatgggggtagtttggtttgagaatttggtgggggttgtgttttttggttttttttgtagtggggaaattttgtgtttagagtgtgatttggagtgggtagtggtggttatgggggtttggtggggtagtagttaaggattagtagagtgttgtgtttttttgtttatgaattgtatgaaaggtttgttttatttggagtattgagtagtggggattaagttgttggttgtttttttatttttttgttattatttttagttgttagttatggttttggttttggtttttggttagttttggttgttggatttttttaagtataggttggaggtgtatattatttttgatatttttagtttggaggttgtaggtaaggtgttgtgttgttttgtagatatttttgtttagttgttttgtgttatttgtttttttttgttttaaggaagttagtttttttggggggaggtgtggtgggagtggttgtttgtttggttttttgtagaatttttgggagttggaattttgattattttgtatttttttagtttttttttgattggtttggtttttggggtgttaagggtgtgagtaattttgttgttttttttatttgtattttggttttttttttgttttttgggttataaaaattttagtattttgatttgaggatttttagaggttgttgatttttgtttttgttttttttttggtttttagtttttgaggagttttatttgttaggaaattgtttgaaattatttagaaatgttttttgtgaagaggtattttttttttttttttgggaaagggttggtgaattttggtgtttaattgaatttttatatttttttttagtttttttaaattgtatggaaatttgagttttttgtgagggggaggggggtttgtaaattatgtgtgtgtgtgtgttttaggagatttggtgtgtttgtgtagaggtgtataaatatatttgaaagtataggttataaaagtgaatgtgttgttgtagtgagataaatatgtaaataaaatgtgtggtgttgggggaggggaggaaatggggtgtggatatttatatttgtgtttgtatattttataggtgtagtgttttttgtggtttggagttgttgtgtgtatttttttttggtgttaggtagtttagtttttttatggtttttgttgttggtttagttggtgtttgtgttgtaggtgggtatgttgatgggaaagtgtgtgtgttttgtttttagagaaagataaaagttagtaggggaagaatgaggatgtgggtgttgaggatttgtttaagaagaagtggtaaaggtggtagtggatttattttattagttagtagttttaggagttggaggttattttttagaggaattgttatttggatatgtttatatgtgaagaaattgttgtgtggattaattttatggaagtttgagtttgggtaggagttagtatggagtttgggagggatggggggaggatgttgtggaggtataggttaagtagattaggagagaatgtggaaggtagtgttgtttgggagggtgttggtggggtgtagttttgtaaaggtagaaggttttgtggtggtttggttgtgagattatagttttttttttgaggttgataggattgttgttttggtttaggtttttagagtggtattggtttattgttttgttattttgtgattttatgagttgggttgtatgggtaattttttgtataggatattgtgtttttggtttgtagttgttagagtagagttaataaaatttttattaggttaagagttgtgaataggttttaatttgtgagtttttaataaggaaaatttgttagagatatggaagagttggttttttttgggaaatttttgttttggttttggtttagtttttttttttttgggtttgtgttttttatattttttttatggttgttttggttatttaggttttttttatatattttattttttagttttgtgatttttgggagtaaagttttaatatataattattagtttttttagaaggagaaagaaaaaaagaagaaagatttttttgtttggtttatttatttttttttaggagttgaattttggaaattgaaatttatatttttttttttaaattataattatagttttgtaaaaagggtttattttaattttgtagtaaatttgtattttatggattggtaaaaatgagtttaaataaataatttaatagtaatgttttggtttatgttggttggtggaagattttaaatttgttaggattttggaagtagaaaatagaattaagtaaattaagtggtatttagaggttttgttgttaaaaaaaaaaaattaagtgttttgggtagaaaaaataaagtttttggttagagtagagtaaataaaaagaagaaaataatgataaaaagaataaagattaaaatgtttttttaaattagagggaatgaagatattttttgggtggtatttgtgtaaggtatgaggttatgttggtggataaaaggttgggaagaagttgaaaatggttttagtttaattgtttagagttagagttgggttttgggtggtgtggttttgagtaaggttagttttttattagtttttttgtatattaagggaatgggttttttatgtattttttttgtttgagtaaagtttagatggtttagggtagaaatggtaagtaattaaagatagagtttatgggttttttgggattttttgaaaatgtttttttattttgtttgttattttgtagttttattttagtgttttgtagttgtggtgttgggttttttttgtagttgtttttttttttagggtggttgtttgttgagttaagtgggagtgaggtgtgttttttatagtagttgggtgtaaagaggaagggggataaaaaggaaattaagaatgaaaggaaaaagagaaaaagtggattatatggttgggtttggtggagatgtgtaatgtgaaatattattggtgttagtttggatattttaggttaggtttttttttaatatataaaagttgttgtttggggtgatagggaggtttgatgtggattgggattggggttgtggttgggttattggatatgggtggaagttggttggtttgggtggttgtttgtaaagttaaatgatttggttgggtttggtgtgtggataggtttgtggtgggtttagggtaaagaagaggtagagtgaaagaagggggaatttttaaaattattttttttgggtttttggagtttaatatgttaagtttttggagttaatgagttgatgaagaggtggttttttgttttttatttggttgttttgttaggtgagaaagagtgttggtggtttagtttttgttaagggagtatgtattagggggtgggggatgatagtggaggttagggaaggaagggaggaattgtgtgggagaaagagtgattttttagtgtttttttagttttttttttttatttgtgggtttgtggttttggaatggaagtaagtttgtaaggtgttttgggaagggttggaaaagtttgttgttttgtgtttgttttatattaagtgtttttggatttggagaaatgtttggttgagtgattaaattgtttgtaggtttttatgtgtttggttgaggtttgtggtgtagttttgagttttagtttgtaggttagagtagattaggttttttgtgtttggtggagatttgggttagtaattgaaagttggttttggtattttggtgtgtagggtggtgtagtgaagtgaggttagggtgtgtgagtgtgttagtgtgtgtgttgggggaaggtgggggttggtttttgatggaagttttagtaatttgtattgtggtatttgtttgtttttttgttttaattgtttttaggtttggtttaagaattgttgggttaaatggagaaagagggagtgtaattagtaggttgagttatgtaagaatggttttgggttgtagtttaatgggtttatgtagttttatgatgatatgtatttaggttatttttataataattgggttgttaagggttttatatttgtttttttatttattaagagtttttttttttttaattttatgaatgttaattttttgttattatagagtatgttttttttatttaattttattttgtttatgagtatgttgtttagtatggtgtttttagtagtgataggtgttttgggttttagttttaatagtttgaataatttgaataatttgagtagtttgttgttgaattttgtggtgttgatgtttgtttgtttttatgtgttgttgatttttttgtatgtttatagggatatgtgtaatttgagtttggttagtttgagattgaaagtaaagtagtattttagttttggttatgttagtgtgtagaatttggtttttaatttgagtgtttgttagtatgtagtggattggtttgtgtgagttgtatttatagtgttgggattttaggattttgttggatggggtaattttgtttttgaaagattgggaattatgttagaaggttgtgggtattaaagaaagggagagaaagagaagttatatagagaaaaggaaattattgaattaaagagagagtttttttgattttaaagggatgtttttagtgtttgatattttttattataagtatttttaatagttgtaaggatatatatataaataaatgtttgattggatatgatattttaatattattataagtttgttattttttaagtttagtattgttaatatttaaatgattgaaaggatgtatatatattgaaatgttaaattaattttataaaagtagttgttagtaatattataatagtgtttttaaaggttaggttttaaaataaagtatgttatatagaagtgattaggattttttgtttgtgagtaagggagtgtatatattaaatgttatattgtatgtttttaatatattattattattataaaaaatgtgtgaatattagttttagaatagtttttttggtggatgtaatgatgtttttgaaattgttatgtataatttattttgtgtataatattttgtataatattattgttttattttttagtaaatatgaaataaatgtgttttattttatgggagtaaaatatattgtatataaattggtttggattttttttttttttttttgttattaatttggttaggatattttagttattgttttttaaataaattagttttttttgtttgtttagttaaatatataaggtagtagtttttatttaaatttggtagaaataaatgatagttatttattagaaattaaaaagaaaaaaaaaggtatttttgggggggaaaagggttataaaatttaattttgtttttttaatttttttttggtttaaatttagaggattttattatggttagtaaataatatgaaaaagaaaaaagaagaaagaaatttagtaagtttattagtttaaaatgatttttaagtttatttttttatggggaaatttatatttttagtaaattgttttggagaaatatttgtgtatgtatatatgtatagtttatatgtattttttttaggaggaatatatttataataaatttatagggaaatatttttagtttaaaatatttaggtttttatgtttatttttaggtttaagtagagagattttttatgttatattgtattattatttttaaattttttggagatattaaaagaaataaagatgatttttaataattatagttttttagttttttaaagaatttaggggttgagaggttagagtggagttttttgagttttgttgagtaatatgtagttgaggtaaaggttatgtttttggtgttttgttttaaataatattgatttattaattttaaatttgtttgtttttgaaattatataggattatagtttgtaaattgtaggataatgaagtaaattaagatgaattatagttttggttttttttgttattttttgatatttaaatagggaatgagtttggtgtgagtgtttaaatgaattttaagtatttgatttttttttatttgtgatttttagttttaaaaaaatgtgaaatttgattttataataaatagaaataaatattatttagttttagagaatttatttttatggtgttaggagggttgttgtggaggtggggggagggatgtgttgagattttttgttatgtttgttaattttttgtataattaaagtgggtgagaataaatattatgttggggaatttagagtaaaaagtaattgttgattttttggagttgataatattattgtttttttgttttagttgtttttatttgaatgaaattttatttagaagtttttggagtttgaatattgagtttttgttttgtaagaaattgttgttgttatttaaagagattgtagataatgtttttgatttaagattagtgtttaatgtatattttttttttttttaaagttttgtttttgatttgtggagggattatgtagtagtggggggtagataaaagttttttggatgagggttattttttattatgttgtttatttgagagtagtggagaggaaaatggtttttatgggtggattttggtttttggagttgtagggtttagtggttttggtttttttgttttttagtttggtagggggtggggagggttaaagggtggaggggaaggaaggagttagaagaggggatttggggatgggggttggaagtgttaatgagatttgtttggaggatttaggttttttgtaggttggtgagtgatttgggagttttgggtaaaagaggtgtattttggtttagtttggttgttgaattagaataatgtgaggatattaattaatttgtaggaaataaaaaatggaagttgaggtttaggaagagttgttatttttttgatttgagtggtgtaggttgggggtggagatttgggatttaagagaggttattttttttattttagttttttttttttggatttttaaaaggaataattttatttttttttttgttttttttataatttttatttttgttagtttgtaggttgtttgtttttttttgtattttttttttttatttagtgagagaaatttagtttttagagt

SEQ ID NO: 1138 - DNA, 8252 bp, Artificial Sequence
  chemically treated genomic DNA (Homo sapiens)
gttattgtggttgggttataggtttattgttttgtggtagatggaagatatgggttttggtaatatattgaaatgttataggaaattaaattagaagtgatttaatttataagtatatttaggtttatttaatatgatgttttaaggtgggtggggggtttaaattagtagtttagggttattaaggttttaggttttgggttttattttattattatataatggttgtttgtaatattatattatatttattttttataatatttaaaggtaggttgtaagggttggtttaggaagttagagggtgttttttatttattaagggagaagtttgttttatttttaaggagatgttttttatgttttatgggttatatagaattgtatggttatttttggttaaaagaggggttgggaaagtgaattttttttttttttttttttgtagagtgtaagttaggtaagaaagaatggatggtggatagttaggaaatagttagttatgagatgttgtgtggaaagtttatttttttgatattggagaattgtgggaagaatggataggttatatattagttgggttttgagaatttttagtttttgttttatagtgagttagtaggaatttaaagggtatgggtagattttaggggtttttttattttatttaggggtagagagggtaagatggagtagagtgaggtaagagattgagtaatgtgtttttaaagattgtgattgatagaagttgtgtaaattattatgataaattgaattttaagaggaattggattaaataaagttagtttatttttatttgtaattagtagatagagagtgtaagattagatatattatagatggaaaagaaaagttaaaatttttttgtatatttgagaggtaagaggaggtgtttgtggtttttttgatatatatgtgatatatgtattattatggtttatgtgtgtgttgttgtgtgtagggggtagggggttttttgtttttgatggttttttttggtgggtgttttttggttttttaggtttttttatttgttgaatgtggtagttaagggtttgggaatgatttgttagattggttaatgtggaaagagttggttttgtttagttttgtatttttttttttttttttggaattgtttggttgtagagagtaggagttttttagagtttttgggggattttatttttagtataattgtgtaatgtgtgtttagtataagagtattagatggagggataggtgggaggaggaggaatttagggtgtatttagtttggggtttgttgagttgaggtttttagagtaaggatgattaggttggggggatatttttttttaatttttgttaagttatagaggggttagtgggaataaagtgatattttggtttttgtattttttttttgttgttttattttttagtttgtttagatttgaggttggggaggggtttttttggaggggttagtttatgttattttttgtaatttttattatatatgtttttagatattttgttataggttttattttttatgttaatttttatttgggaaagtaaataaatggaaagttaatttgtgttatttggttgttggggtatttgtagtgagtagttaagaaatgttaggggagttggtgtttatttttatgtttggataagagtgtgttttggatttgtgttttgttgtatattttattgttttgttgtatattttattgttttattgtatattttattgttttattgtatattttattgttttattgtatattttattgttttattgtatattttattgttttattgtatattttattatttttgttttttgtatttagttgtttatttgtattttagtttaggaagtttagaagatgtagaatttttgtgagagtttagggtgaaatgttgtgttttatttttaaagaaaggaaaattatttatattttttaaaagaatgaatagtatagattaatattgattttttttaatttttaggttaattttgagtagttaaagttagagtagttaatttgtgttgtgagttgaggtatagttgtagaagtgtgtttgaggtgtttggtggaggtggtagttgagttttgggattaattattgtgttggggatggtattgtgttaggatgtaggtagatttttgtagaagtgtttaaaatttatatttttttataggggtgagggggagggagaaagagatgttttagtgaggataaatatttttttttatatttaaataattatagagtttttattttaaagtatttataggtatattttttagaaaatatgaattgttagttgggtatggtggtttatgtttgtaattttagttttttgggaggttgaggtgggtagattatttgaggttaagagtttaagattggtttggttaatatggtgaaattttgtttatattaaaaatataaaaaaaatttagttgggtgtagtggtatatatttgtaattttagttattaggaagttgaggttgaatttaggaggtagagattgtagtgagttaagattgtattattgtattttagtttaggggtaatggagtgagattttattttaaaaaaaaaaaaaaaaaaagaatatatgaaatgtttttagattttgttatgttttttttttttattttaggtaagttagaaagtgttattaatagtggttttttttaggtttttggttagagatgtgaagagaagttggggggaaattaggtttttttttaagttttttagttttgtttttttatttttggatttgaatgtagtttgatttaggttattttattgtattattattggtggttgtgattttgtgtaaaggtatagttggtgatgttgattagagtttttgtagttttaaatgatttttttaattaattttaaatttttagaatttattgtataaaaaggttatattttttggagggatgttgatggtattaggatagaagtattaggggattttatgaatggtgttgttgaaatagtagtttttatttgtatattgggagggtgtgatattaggaaaattataattttgttttttatggggggttattgtatatgtttttgaaagtgtataggtaagaagtaaagtaagttgtgggttgaattttttgatgttattatgtatatatttatttagtttttttttttaatgatattagtaattgtttagtgaggtggatataaaatttttaggatatgagagggagatgtggtttttatattttgatgtgtaaatattatgtttagggaaaatgtaaggtgttttaggtttgtggattttgtatttttttaggtaatttatttatttattttttaattttaataaatgattattaaattttatttaatatataaatatttattgagtattatttgtgtgtatgagaagtgggagttagtatggtaaaagttaggtattgtgttaggtgagagagatttagaaattaaaattagagaagttattaataagagtttaaatatttgggtttaggtttatgtttgtaattttagtattttgggaggttgaaggaggtgaattatttgaggttaggagtttaagattagtttgattaaaatggtgaagttttatttttattaaaaatataaaaaattaggtgggtattgtggtatatgtttgtaattttagttatttgggaggttgaggtaggagaattatttgaatttaggaggtagaggttgtagtgagttaagattgtattattgtattttagtttgagtgatagagtaagattttattttaaaaaaaaaaaaaaaagagtttaaggatttgatggaggagaaaggtaagaatatgtgtgagataatgtaaggttattgttttagggtgtttagggtaattatgggggtagggtattttttggagaggttaatgataagtaggttgaataaagtaggggggttttttgtaggaggaggtttattaggtgaagatggagttgtatgggtaaaggttattttagagatttaggtgtgtttaggaggtggaaatttattgtaggtaaggtgagaggattgggtggggtggtttaggaggagttgatagagggtataagttgtgaaatagtttgaagtagggtagtgaggaaagggatttagaggaggaagatatgtggatagatggggttggttgggggttgttgtaggattttatgtaagaggttttaatattagagttttaggttttgagttttgtggaattaaaggttttagaaagtaatttattaggatttggtggttgatagtttgtagtagggggtgaaagaggagtttagagtattttttggtttttgtttttgttttggggtataggaggggaggaatttagtttggttatattggtttaggtgagggtgttttaggggaggttgagaggggttgtttttttgtttgttttgttattagggattgttttgagatgtttttggagaaagtgtttttggtttgttgggaaggatttgtgtttagtttttgttgtttagtagtttttatgggaattttgtttttttggggtttggatttattgtgatgtgaaggtgattattgtttatttttgggatattgtgggggttaagagaggttttgtggtgagggaggattattattttgggggttgggggggttttttttttagggaggaagatttttagttttggtgttttgtttttggtagattttgttttgtttatttgttttgtttttgttgtatgatggaaataaatggaaatggtttttatatatgaatgtattaaattgtaattataattttttagattttagttgtaataggattatggatttgagtgatttgtaaagatgttttgagttttgagttagagggtgtgtggggtggggaggggagtttgttatggtttttgtgattttatagtatagggggtagagttgggggttggggtgggggtaagggtgtaggtagatgggtttgggggtggttagtatggggatttatttagtttgttttgtatattgaggttatttttttttttgggttttaaagtttttttgttttttgttatgggtttgggggtttttttattgtagtttaatgttggttgtttttttatgttgtttaagtttattttttaggtttggtattttatagtagagattaagaggtggttggagggtagtgggggtatggatagtattattgggtgttttttttttaggtttttttggaaatttttgttttggaaatgtagaaagtttttttttttgtttttattttgaaattgtatttaataatggtaaataagttatttagttttttatagttggtaaagtgtaagttgtagatgttgttatatagtattttttgatagttttagggtagattgttgatttattttgtaggtaaaggagttgagatgtaaatattttttaaggaagtaagaatggtttttttttttattttttagaaggatttagggtaattgatttatttgataatattagggaatatgggttgttagttatgtatttatgagagaggtggttttgatttttagagtatggattttaggggagtttaggaatttgtaggagagggttttttagttggttattattgggatgggtatttgggtttgtgggagagggttttttaggtggttattattgggattggtatttgggtttatttggatgggttttgggagggtttgtttttgggggagatgttggtatgaatagttaaaagtattattttgagattttatgttaatattttttttttgaaatatgatatttgggaggattgtatagtttttttaatataggaaaatagttttgattgaaggtagttttttttttgttgtattttttgaaggtttttgggggttttgttattttgagttattttttatttgtttttgttgattttgtaaattggatatatttttaagggtttagaatagtatttggtataaaataggtgtttaaaaatatgtatgtaaaatagtggtttttggtggaggttgttagagttggttgtggttttatagagtaggaagaagtatgttttatttgtttgggttttggttagggtgttgagggttagtatggatattaggattagggtgtagattattttgttttttatggtggttattgttttttttttgttttaaaggtgattttgagttagggatgagaggttgtttgagttttggattttatagggtaggttttgtttgtttaaagagtgttagataatatttgtttaaggaggtttggggattttttgagataataatttttattgatttttattaaaggtgttttttagatatggttaagttatatggaaggatttgttgatagatagagatgatatgtggtgaggttattttggttgagggatttgagatttagaaagttttttttttttatgggagttttttttaatttgattttaatttaggttttatttatatttgagaggtttttttgttagggtaaatattgtatttattgtagaagtgatttatagtgagagatggttggaaaaaggtttggttgtgataatagtggtttatggggtggttattgtgattttgtagggggaagggaaggagtttatgaagtttattttgtttaggtttaagttaatttttttatagtggaattgttttaataatgaaattgtaggtttggtgtagtggtttatgtttgtaattttaatattttgggaggttaaagtaggtggattatttaaagttaggagtttgagattagtttggttaatatggtgaaattttgtttttataaaaaaaaaaaatataaaaattagttaggtatggtggtgggtgtttgtaattttagttattttggaggttaagttaggagaattatttgaatttgggaggtggaggttgtagtgagttgagattattttattgtattttagtttgagtgatagattaagtttttttttgggaggggttgggggtaggagggagaaaaaaatagtatatatgagttgttattaaaaattgataaagtgaatgtggtttatttttttgtgtttatggggtttttttttttttttttttatatttttttagttggttttttggatttttgtattttagaggatagttttttgtttttttgtattatgttttattttttttttttgtttggagtttttttttttatagtttttattattttttggtggataaaataagtgattgatatattatgttggttatttatttattgtatttttttttgtagtagatgggagggtgtatgggagtagaagtttttattttttagtgttttgaggtggttttagattttagaatagtggttttgattggtatttgagaaatagttgttgaagagttgtatgaagaaatggataataggagaaatttttttttttttagtgagaaattaggttttgaggaaaatgtatgttagtttaataaaggtattatttttttttgggtgatttagttagtatatttttgtagtttttttgggaggggagtttgggttagaatgggggtggttatgtttttttttgttttattttaggatttagttttttttttagggttgttatttttgtattggggtttttatttttgggttagggtttttaggaggggtttgattgtaggatttagggaggggttgaggtttggtgttttttgtggttagtttaagtttattgaaaataggatgggggtattaggtttagggtggtgtttatagtgatggtggtttttgttgttttaattttttggattaaaatgggggtttttggaaatgggatgtaaattgtataattatttggagaaaaggtgggtagtgtttggtgaggtttaagttatatagattttatagtttagtaaatttttttgtttttaggtttggttttttaattttagaaatatgtttatatttgggtagaagaaaatataggtaaagatattttttttagtattgtttgtaatagttggaaatagggaaagaaggaaggaaggaaaggagggaaagaaaagtaaaataaatatttattaattagggaaagggaaaatgaatttaaaatataatgtagttgttttttagtatttttgggggattggttttaggattttttatttagggatgttaaaatttataaatgtttaagttt

SEQ ID NO: 1139 - DNA, 8252 bp, Artificial Sequence
  chemically treated genomic DNA (Homo sapiens)
ggatttgagtatttgtggattttggtatttttgggtggggggttttgaaattagttttttaggggtattaagggatgattgtattgtattttaagtttattttttttttttttggttaatgaatatttattttgttttttttttttttttttttttttttttttttttttttgtttttagttgttataaataatgttaaaaagaatatttttgtttgtgtttttttttgtttaagtatgaatatgtttttgggattaagagattaggtttggaaatagaagaatttgttgagttgtaaaatttgtatggtttaaattttattgaatattgtttattttttttttaaatgattgtgtaatttatattttatttttaagagtttttattttgatttgagaaattagagtagtgaaaattattgttattatgagtattattttgggtttggtgtttttgttttgtttttaataaatttaagttgattatagaggatattaggttttggtttttttttgggttttgtggttaggttttttttggagattttggtttaggagtggagattttggtgtaggagtggtagttttggaggaggggttgggttttgggatggagtgaagaggaatatggttgtttttattttggtttaggttttttttttagaggggttgtagaaatgtattgattaggttatttaagaaaagatagtatttttgttaggttagtatgtattttttttagggtttaattttttattgaagaagaaaagattttttttgttgtttatttttttatgtagttttttaatagttgttttttgaatgttaattaaagttattgttttagggtttggggttattttaaggtattaggagatgaggatttttgtttttatgtgtttttttgtttgttgtagggaggagtgtaatgaataaataattaatataatgtgttagttatttgttttatttattaggaggtaataagagttatgaaagagaaagttttgagtaggggaggggagtgaggtatggtataggagagtaggaggttgttttttaaaatataggagtttaggggattaattgggaaggtgtgggagggggagggagggagttttatagatataggggagtgaattatgtttattttgttagtttttgatggtagtttgtatatattattttttttttttttttgtttttagttttttttagaaggagatttaatttgttgtttaggttggagtgtagtagggtgattttgatttattgtaatttttgttttttaggtttaagtgatttttttgatttaatttttagagtagttaggattataggtatttgttattatgtttggttaatttttgtattttttttttttgtagagatggggttttgttatgttggttaggttagttttaaatttttgattttaagtgatttgtttgttttggttttttaaagtgttgggattataggtgtgagttattgtgttaggtttataattttattattaaaataattttattgtaaaagaattagtttaggtttagatggaatgggttttatgagtttttttttttttttttgtaaggttatggtggttattttgtgagttattgttgttatggttaagtttttttttggttattttttattatgaattatttttgtagtgagtatagtatttattttggtgggagggttttttagatatgagtaggatttggattaaggttaggttggaggagatttttatgggaaagagggattttttgaattttagattttttagttaagatgattttattatatgttgtttttgtttattagtaaatttttttatgtagtttgattatgtttaggaaatatttttgataaaaattagtggagattattgttttagaggatttttgggtttttttaggtaaatgttatttaatgttttttaagtaaatagagtttgttttataaaatttggggtttgggtggttttttatttttgatttggggttgtttttggagtagagaggaggtaatggttattatggagaataaggtgatttgtgttttggttttggtgtttatgttggtttttggtattttggttgaggtttagataggtaaggtgtgtttttttttgttttgtggggttatagttagttttggtagtttttgttaggagttattgttttatatatatatttttgagtatttgttttgtgttaggtgttgttttaggtttttaaaagtatatttaatttataggattggtaaaagtaggtggagagtaatttagggtggtagggtttttggagatttttgagaagtgtgatgaggagggggttgtttttagttggggttgtttttttgtgttaggaagattatataatttttttaagtgttatgttttaaagaggaagtgttggtgtggggttttagaatagtgtttttgattgtttatgttaatattttttttaggggtagatttttttaaggtttatttagataggtttaaatgttggttttagtgatggttatttgggagatttttttttataggtttgaatgtttgttttagtggtggttaattgggagatttttttttataggtttttgggtttttttgggatttatgttttgggagttaaagttattttttttatgagtgtgtggttggtaatttatattttttggtgttgttaagtggattggttgttttgggtttttttagggagtggaggaggaggttatttttgtttttttgggaagtgtttgtattttaatttttttatttgtagaatggattaatggtttgttttagggttgttaggaaatgttgtgtggtagtatttgtgatttgtattttgttagttgtggggagttgaataatttatttgttgttattaggtatagttttaaggtgggggtaggagaaagggttttttatgtttttaaagtaagggtttttagagaggtttgaagagggagtgtttagtggtgttgtttgtgtttttattgttttttagttattttttgatttttgttgtggggtattgggtttgaggggtgggtttgggtagtgtagaagagtagttagtattgggttgtagtgggaagatttttaagtttatggtagggagtgggggagttttggaatttgagagaggaagtggttttggtgtatagaatgaattgggtgggtttttgtgttggttatttttaggtttatttgtttgtgtttttgtttttattttagtttttagttttgttttttgtgttgtgggattatagaggttgtggtaaatttttttttttattttatatattttttggtttaaggtttagagtgtttttgtgggttatttaggtttatgattttgttataattgaaatttagaaaattgtgattatagtttagtgtatttgtgtgtggaaattatttttatttatttttattatgtgataaagataaagtgggtgggtaagatagagtttgttggaggtagagtattggggttggaaatttttttttttgaggaggaaatttttttgatttttaggatgatgatttttttttattatggggttttttttgatttttatagtgttttgggggtgggtgatgattatttttatgttgtgatggatttagattttaggagggtaaggtttttatggaagttgttgggtagtgggagttgaatatggattttttttagtaagttaggaatattttttttaaagatattttgaggtagtttttgatagtaaagtagataagagaatagttttttttggttttttttggggtgtttttatttgagttagtgtggttagattgagtttttttttttttatgttttaaggtagggatagggattggagggtgttttgggttttttttttattttttgttgtaggttgttaattattagattttaataggttgttttttgagatttttgattttgtggagtttagagtttgaagttttggtgttagaattttttgtataagattttgtggtagtttttagttagttttatttgtttatgtgttttttttttttagatttttttttttattgttttgttttaagttgttttatagtttgtattttttgttggttttttttagattattttatttggtttttttattttatttgtaatgggtttttattttttgaatatatttgggtttttggaatggtttttgtttatgtggttttatttttatttggtgaatttttttttgtagggagtttttttgttttgtttaatttgtttgttattggtttttttggggagtgttttatttttgtggttattttgggtattttgggatgatggttttgtgttgttttgtatatgtttttgttttttttttttattagatttttagatttttttttttttttttttgagatggagttttgttttgttatttaggttggagtgtaatggtgtgattttggtttattataatttttgttttttgggtttaagtgatttttttgttttagttttttaagtagttgggattatagatgtgtgttataatgtttgtttaattttttgtatttttagtagagatggggttttattattttggttaggttggttttgaatttttgattttaagtgatttattttttttagttttttaaagtgttgggattataggtatgagtttgggtttagatatttagatttttattaatgatttttttggttttaatttttgggttttttttatttggtatagtgtttggtttttgttatgttagtttttattttttatgtatataaatggtgtttagtaaatatttatgtattgagtaaaatttaataattatttgttgaaattaaaaagtgaataaataagttatttagaaagatgtaaagtttataaatttggggtattttgtattttttttgagtgtaatgtttgtatattaggatgtgaggattatgttttttttttatgttttgagggttttatatttgttttattggatagttgttgatgttattggagaaggaagttggatgggtgtgtgtatgataatattaaggaatttagtttataatttattttgttttttatttgtgtatttttagagatgtgtatagtggttttttgtgaaagatagaattgtggtttttttggtgttatgtttttttagtgtgtaaataagggttgttgttttgatgatattgtttgtggggttttttggtgtttttattttaatattattgatgtttttttagaaggtatggtttttttatatgatgggttttgaagatttagaattagttagaaaagttatttaagattatagaggttttgattagtattattagttatgtttttatatagagttatggttgttagtggtggtgtaatggggtagtttgagttaggttgtatttaggtttaggaatagaaaggtagggttaagggatttgggaagaaatttgatttttttttggtttttttttatatttttaattaaaagtttgggaagagttattgttggtaatgttttttagtttgtttaggatagagggggaaggtatgatgaaatttgaagatattttatgtattttttttttttttttttttttgaaatggagttttgttttgttgtttttgagttggagtgtaatggtgtgattttggtttattgtaatttttgttttttgagtttaattttagttttttagtagttgagattataggtgtgtgttattatgtttagttaaattttttttgtatttttagtatagatggggttttattatgttggttagattggttttgaatttttgattttaggtgatttgtttgttttagttttttagagagttgggattataggtgtgagttattgtgtttggttgatagtttatgttttttaaagaatgtgtttatggatattttaaagtaaaaattttgtaattgtttaaatgtgaaagaaaatgtttatttttattaaagtattttttttttttttttttttatttttgtagaggagtgtgaattttagatatttttgtagggatttgtttgtattttgatgtggtgttgtttttagtatggtgattagttttagagtttggttgttatttttattggatattttagatatgtttttgtagttgtgttttggtttataatatagattgattgttttgattttgattatttaaaattggtttaaaaattaaaagagattgatattaatttgtgttgtttatttttttaaagaatatgaatgatttttttttttttgaaagtgaagtgtagtgttttattttgggtttttgtagaggttttgtattttttgggttttttgagttgggatataagtgggtagttgagtgtagaaagtagggatggtggggtgtatagtaggatagtggggtgtgtagtaggatagtggggtgtgtagtaggatggtggggtgtatagtaggatagtggggtgtgtagtaggatggtggggtgtgtagtgggatggtggggtgtgtagtaggatgtaagtttaagatgtatttttgtttaggtatgaaaatggatattgatttttttggtattttttaattatttattgtggatgttttagtgattaagtgatataagttagttttttgtttatttgtttttttaaatagaaattggtgtaggagatgaaatttgtagtagaatgtttgaaagtatgtgtaataaaaattgtagagggtggtatggattgatttttttaggaaaatttttttttaattttagatttgaatgaattagaaaatagaatagtagaggagggatatagaagttaaaatgttattttatttttattggtttttttgtagtttggtaaggattgggagagggtgtttttttaatttagttgtttttgttttggggattttagtttagtaagttttaagttaaatgtattttgggttttttttttttttatttgtttttttatttggtgtttttgtgttgggtatatgttgtatagttatattggagatgggattttttgggagttttggaaagtttttgttttttgtagttagatggttttagggaggaagagggaggtgtagaattgagtggggttagttttttttatattaattagtttggtaaattatttttaaatttttggttattatgtttagtagataaagaggtttgagaggttgggagatatttattaagaagaattattaggaatgggaagttttttgttttttgtatatagtagtatatatatgagttgtaataatatatatgttatgtatgtgttaggggggttatagatatttttttttattttttagatgtgtaaggaagttttagttttttttttttatttatggtatgtttgattttatattttttgtttgttaattataggtaaaaatgagttaattttatttagtttaattttttttaaaatttagtttgttataataatttgtatagtttttgttagttatagtttttgggaatgtattgtttagttttttattttgttttattttgttttgttttttttatttttgggtggggtgaaggagtttttggggtttgtttatgttttttggatttttgttggtttattgtggagtagaagttgggggtttttagagtttagttggtgtgtggtttgtttgttttttttatagttttttagtgttagaaaggtgggttttttatataatattttgtagttgattgttttttggttgtttattatttgtttttttttatttaatttgtattttatgaaggaagggggagaaagaatttatttttttagttttttttttagttagaagtggttgtgtaattttatgtggtttatgagatatagggggtatttttttgaaggtggggtaggttttttttttgatgaatgaagagtgttttttggttttttaggttagtttttgtagtttgtttttgggtgttgtggaaggtgggtgtgatgtggtgttgtaggtagttattatgtaataatgaggtaaggtttaagatttagagttttaataattttgagttattgatttgagttttttatttattttgagatattatgttaaataaatttaagtgtgtttgtgggttaaattatttttggtttggttttttgtggtattttagtatattattaaggtttatattttttatttattatagagtagtgagtttatggtttagttatgatggt

SEQ ID NO: 1140 - DNA, 408 bp, Homo Sapiens
tcctcaactctgcaggcctgaaagaaggtcacacacgcacgctcacacccacactccacacgcctcgtcccaaacaaccccatgaacattgtcctttgttccgtctcttgggccactttccctgtcgcttcctcccagcccgtcctgatttgctccccaaaagtacgtttctgtctccccgctgccctggcgctccccctttgatttattagggctgccgggttggcgcagattgctttttcttctcttccatcccatcctcccttctggtcctcctttccacagtgggagtccgtgctcctgctcctcggttggctcctaagtgccccgccaggtcccctctcctttcgctctcccggctccggctcccgactcttcggcccgctggcatctgcttccctcccctgc

SEQ ID NO: 1141 - DNA, 144 bp, Homo Sapiens
ttctggtcctcctttccacagtgggagtccgtgctcctgctcctcggttggctcctaagtgccccgccaggtcccctctcctttcgctctcccggctccggctcccgactcttcggcccgctggcatctgcttccctcccctgc

SEQ ID NO: 1142 - DNA, 162 bp, Homo Sapiens
tggcatctgcttccctcccctgcctcgtttctcgtcgcccctgctcgctccccccggcgctcgcccgggcgctgtgctcgctcctggatcgccagccgcgcagcgggctcgccggcgcccgcgcgccactgtgcagtggagtttggtggaatctctgctgac

SEQ ID NO: 1143 - DNA, 22 bp, Artificial Sequence
  PRIMER
gtaggggagggaagtagatgtt

SEQ ID NO: 1144 - DNA, 24 bp, Artificial Sequence
  PRIMER
ttctaatcctcctttccacaataa

SEQ ID NO: 1145 - DNA, 20 bp, Artificial Sequence
  PROBE
agtcggagtcgggagagcga

SEQ ID NO: 1146 - DNA, 27 bp, Artificial Sequence
  PROBE
agttggagttgggagagtgaaaggaga

SEQ ID NO: 1147 - DNA, 25 bp, Artificial Sequence
  PRIMER CONTROL
tggtgatggaggaggtttagtaagt

SEQ ID NO: 1148 - DNA, 32 bp, Artificial Sequence; identical to SEQ ID NO: 1103
  chemically treated genomic DNA (Homo sapiens)

SEQ ID NO: 1149 - DNA, 14 bp, Artificial Sequence
  chemically treated genomic DNA (Homo sapiens)
ttcggttgcgcggt

SEQ ID NO: 1150 - DNA, 24 bp, Artificial Sequence
  chemically treated genomic DNA (Homo sapiens)
ttctaatcctcctttccacaataa

SEQ ID NO: 1151 - DNA, 22 bp, Artificial Sequence
  chemically treated genomic DNA (Homo sapiens)
gtaggggagggaagtagatgtt

SEQ ID NO: 1152 - DNA, 144 bp, Artificial Sequence
  Example 3 amplificate 1
gcaggggagggaagcagatgccagcgggccgaagagtcgggagccggagccgggagagcgaaaggagaggggacctggcggggcacttaggagccaaccgaggagcaggagcacggactcccactgtggaaaggaggaccagaa

SEQ ID NO: 1153 - DNA, 24 bp, Artificial Sequence
  chemically treated genomic DNA (Homo sapiens)
ttctaatcctcctttccacaataa

SEQ ID NO: 1154 - DNA, 30 bp, Artificial Sequence
  chemically treated genomic DNA (Homo sapiens)
gagattttattaaattttattgtatagtgg

SEQ ID NO: 1155 - DNA, 279 bp, Artificial Sequence
  Example 3 amplificate 2
gagattccaccaaactccactgcacagtggcgcgcgggcggccggccgagcccggctgcgcggctggcgatccaggagcgagcacagcgcccgggcgagcgccggggggagcgagcaggggcgacgagaaacgaggcaggggagggaagcagatgccagcgggccgaagagtcgggagccggagccgggagagcgaaaggagaggggacctggcggggcacttaggagccaaccgaggagcaggagcacggactcccactgtggaaaggaggaccagaa

SEQ ID NO: 1156 - DNA, 24 bp, Artificial Sequence
  chemically treated genomic DNA (Homo sapiens)
ttttggaaagtggtttttagtttt

SEQ ID NO: 1157 - DNA, 19 bp, Artificial Sequence
  chemically treated genomic DNA (Homo sapiens)
ccaaacaacccaactcttc

SEQ ID NO: 1158 - DNA, 234 bp, Artificial Sequence
  Example 3 amplificate 3
ctctggaaagtggcctccagctcctggagctgctggctggtaaagtgagtccgctgccgcctttgccgcttcttcttagacgggtcctcggcgcccacgtcctcattcttcccctgctggcttttatctttctctgaaaacgaaacacacacactttcccgtcagcatgcccacctgcaacgcggacgccaactggaccggcggcagaagccgtggaagagctgggctgcctgg

SEQ ID NO: 1159 - DNA, 22 bp, Artificial Sequence
  chemically treated genomic DNA (Homo sapiens)
gatgttgggatttttgtgattt

SEQ ID NO: 1160 - DNA, 20 bp, Artificial Sequence
  chemically treated genomic DNA (Homo sapiens)
cccaaaaaaatcaacccctc

SEQ ID NO: 1161 - DNA, 224 bp, Artificial Sequence
  Example 3 amplificate 4
gatgctgggatttttgtgacccaggaaacagaagggaggccagggtacgaatagagagggcggcagaattgctcgcgcccttagcgccccaggagccgggccggtcgagggagaactaaagggatgcggggtagtcaaaattccggctcccggaagttctgcggggagccaggcgaacgaccactcccaccacgcctccccccggaggggctgacttccttggg

SEQ ID NO: 1162 - DNA, 22 bp, Artificial Sequence
  chemically treated genomic DNA (Homo sapiens)
gagatggtgtgtatttttagtt

SEQ ID NO: 1163 - DNA, 23 bp, Artificial Sequence
  chemically treated genomic DNA (Homo sapiens)
tccataaactacataaaaaaccc

SEQ ID NO: 1164 - DNA, 182 bp, Artificial Sequence
  Example 3 amplificate 5
gagatggtgtgcacctccagcctgtgcttggaggagtccagcgaccggggctgaccgggagccagaaccgaagccatggctaacggctggggatggtgacaggaagatgaggagacggccgacagcttggtccccgctgctcggtgctccaagtgaagcgggcctttcatgcagttcatgga

SEQ ID NO: 1165 - DNA, 20 bp, Artificial Sequence
  chemically treated genomic DNA (Homo sapiens)
gatgtgggtagaagggtatt

SEQ ID NO: 1166 - DNA, 23 bp, Artificial Sequence
  chemically treated genomic DNA (Homo sapiens)
ctcttaacacttctctatcaaaa

SEQ ID NO: 1167 - DNA, 198 bp, Artificial Sequence
  Example 3 amplificate 6
gatgtgggcagaagggcaccactcagagcgtctttagggagcaggcttccaagctccaaagcgaaacaagagtgggcaaagacccccttcttctctccctccctcccccaagaacccctccaataaggaaagctaacgccgaccgcgctctgcccgccccccccccacgcggcagccctgacagagaagtgtcaagag

SEQ ID NO: 1168 - DNA, 24 bp, Artificial Sequence
  chemically treated genomic DNA (Homo sapiens)
gataggtaggtgatattagatttt

SEQ ID NO: 1169 - DNA, 24 bp, Artificial Sequence
  chemically treated genomic DNA (Homo sapiens)
cctaaatacctaaaactaaactac

SEQ ID NO: 1170 - DNA, 155 bp, Artificial Sequence
  Example 3 amplificate 7
gacaggtaggtgatattagatcccctgcggcggcagcagccgctgcagccacgacgcggccctctgagcgcaccctccgcaacgcgcacacgcacacccctcgggcggtcgaacaggagccgggccttgccgcagctcagctccaggcacccagg

SEQ ID NO: 1171 - DNA, 23 bp, Artificial Sequence
  chemically treated genomic DNA (Homo sapiens)
ggaagaatttgttgttggttgtt

SEQ ID NO: 1172 - DNA, 22 bp, Artificial Sequence
  chemically treated genomic DNA (Homo sapiens)
tcaactctttcctctaactaaa

SEQ ID NO: 1173 - DNA, 265 bp, Artificial Sequence
  Example 3 amplificate 8
ggaagaacttgctgctggctgcctcttttcggctctcaggagagtccgtgaactcgacctttttgatttcggagtctttggagaagagacattcaacggccgccggctgcacgcctgggccacgcgcgcgcccgccccacgtgcggagagaggcgtcccggaccgcggccgaaaggagccggggacgggaggagggggaggggcgaggcaggccggaggagaaagagggacaaagagcaaagacccagttagaggaaagagctga

SEQ ID NO: 1174 - DNA, 23 bp, Artificial Sequence
  chemically treated genomic DNA (Homo sapiens)
agagggataaagagtaaagattt

SEQ ID NO: 1175 - DNA, 21 bp, Artificial Sequence
  chemically treated genomic DNA (Homo sapiens)
ccaataacctctccctataac

SEQ ID NO: 1176 - DNA, 213 bp, Artificial Sequence
  Example 3 amplificate 9
agagggacaaagagcaaagacccagttagaggaaagagctgacggcatccccgtcccccggaccctctggcaacccggggcaggatggcgtactctttctgcgcctccccggttgccggcggttccagccgggaggagtaggctggggggcttcggtacacagcgcgccgctgcttcctagtccaccgccccgccacagggagaggccactgg

SEQ ID NO: 1177 - DNA, 23 bp, Artificial Sequence
  chemically treated genomic DNA (Homo sapiens)
agagggataaagagtaaagattt

SEQ ID NO: 1178 - DNA, 21 bp, Artificial Sequence
  chemically treated genomic DNA (Homo sapiens)
acaaaaaaacactaaccctac

SEQ ID NO: 1179 - DNA, 304 bp, Artificial Sequence
  Example 3 amplificate 10
agagggacaaagagcaaagacccagttagaggaaagagctgacggcatccccgtcccccggaccctctggcaacccggggcaggatggcgtactctttctgcgcctccccggttgccggcggttccagccgggaggagtaggctggggggcttcggtacacagcgcgccgctgcttcctagtccaccgccccgccacagggagaggccactggcgatttggttctgatttccttcctgcccaggctggcccctcggggaagcgcccctcgctggggcctcgccgcagggccagtgccctcttgc

SEQ ID NO: 1180 - DNA, 22 bp, Artificial Sequence
  chemically treated genomic DNA (Homo sapiens)
gtaggagaagggggtttttatt

SEQ ID NO: 1181 - DNA, 23 bp, Artificial Sequence
  chemically treated genomic DNA (Homo sapiens)
ttataatcctctaacctctaaac

SEQ ID NO: 1182 - DNA, 329 bp, Artificial Sequence
  Example 3 amplificate 11
gcaggagaagggggttcttacctaattgcacacacgccgacaccagtttgcggcagttggtctccattccccgttatctgcaaaacagaagagaaggaaggctgtaagaagcggcggccgtcgagtgagcagggctcagatgagactacgttacactagctgttaggcgcctactgtgtgctaggcttcaggcgtgtttttccgacctgacagcctctggctgtgcagcagcatctccagcctagcctcgggcccaggacatttatttatcaagaggggatctccctccagagttgccgcaaaagtgcccagaggttagaggactataa

The invention claimed is:

1. A method for providing a prognosis of breast cancer in a human subject having an estrogen receptor-positive and node-negative breast cancer following therapeutic treatment targeting the endocrine pathway, comprising:
   obtaining from the subject a biological sample comprising breast cancer cell genomic DNA to be analyzed for methylation state;
   contacting the genomic DNA in the sample with at least one agent for distinguishing between methylated and non-methylated CpG dinucleotide sequences;
   determining the CpG methylation state of at least one target CpG dinucleotide sequence within a region between positions 1859 and 2144 of SEQ ID NO: 23; and
   providing the prognosis of breast cancer based on the methylation state, wherein hypomethylation as compared to a control sample is indicative of a high probability of at least one of: a relapse-free survival, a disease-free survival, a slower progression of metastases, or a response of metastases to treatment with tamoxifen and hypermethylation as compared to a control sample is indicative of a low probability of at least one of: relapse-free survival, disease-free survival, slower progression of metastases, or response of metastases to treatment with tamoxifen, thereby providing the prognosis of breast cancer in a human subject having an estrogen receptor-positive and node-negative breast cancer following therapeutic treatment targeting the endocrine pathway, wherein the therapeutic treatment targeting the endocrine pathway is selected from the group consisting of administration of estrogen receptor modulators, estrogen receptor down-regulators, aromatase inhibitors, ovarian ablation, LHRH analogs and centrally acting drugs influencing estrogen production.

2. The method of claim 1, further comprising determining a suitable treatment regimen for the subject based on the prognosis.

3. The method of claim 1, wherein the treatment with tamoxifen further comprises an adjuvant treatment.

4. The method of claim 1, wherein the genomic DNA is obtained from cells or cellular components from a source selected from the group consisting of histological slides, paraffin embedded tissues, biopsies, tissue embedded in paraffin or sections thereof, breast tissues, blood, plasma, serum, lymphatic fluid, lymphatic tissue, duct cells, ductal lavage fluid, nipple aspiration fluid, cerebrospinal fluid, bone marrow and combinations thereof.

5. The method of claim 1, wherein the estrogen receptor-positive and node-negative breast cancer is selected from the group consisting of ductal carcinoma in situ, invasive ductal carcinoma, invasive lbular carcinoma, lobular carcinoma in situ, comedocarcinoma, inflammatory carcinoma, mucinous carcinoma, scirrhous carcinoma, colloid carcinoma, tubular carcinoma, medullary carcinoma, metaplastic carcinoma, and papillary carcinoma and papillary carcinoma in situ, undifferentiated or anaplastic carcinoma and Paget's disease of the breast.

6. The method of claim 1, wherein determining methylation state comprises:
   converting cytosine bases in the genomic DNA sample which are unmethylated at the 5-position, to uracil or another base which is dissimilar to cytosine in terms of base pairing behavior;
   amplifying at least one fragment of the pretreated genomic DNA, wherein said fragments comprise at least 8 base pairs of one or more sequences selected from the group consisting of SEQ ID NOS:250, 251, 372 and SEQ ID NO:373 and sequences complementary thereto, and
   determining the methylation state of the one or more target genomic CpG dinucleotides by analysis of the amplificate nucleic acids.

7. The method of claim 6, wherein amplifying at least one fragment comprises use of at least one of methylation sensitive PCR (MSP) and heavy methyl (HeavyMethyl) PCR.

8. The method of claim 6, wherein determining the methylation state comprises use of one or more methods selected from the group consisting oligonucleotide hybridization analysis, methylation-sensitive single nucleotide primer extension (Ms-SNuPE), sequencing, real-time detection probes and oligonucleotide array analysis.

9. The method of claim 1, wherein the methylation state of at least one target CpG dinucleotide sequence within a region of SEQ ID NO: 250 identical to a probe sequence as set forth in SEQ ID NOs: 1100 or 1104 is determined.

10. The method of claim 1, wherein the therapeutic treatment targeting the endocrine pathway is administration of tamoxifen.

* * * * *